United States Patent 10,233,495 (METHODS AND COMPOSITIONS FOR SCREENING AND TREATING DEVELOPMENTAL DISORDERS) - sequence listing, part 169

SEQ ID NO: 1034 - DNA, 112253 bp, Homo sapiens
  misc_feature (11154)..(11154): n is a, c, g, or t
  misc_feature (11174)..(11174): n is a, c, g, or t
  misc_feature (11176)..(11178): n is a, c, g, or t
  misc_feature (11180)..(11181): n is a, c, g, or t
  misc_feature (11183)..(11183): n is a, c, g, or t
  misc_feature (11278)..(11278): n is a, c, g, or t
  misc_feature (11282)..(11282): n is a, c, g, or t
  misc_feature (11288)..(11288): n is a, c, g, or t
  misc_feature (11298)..(11298): n is a, c, g, or t
  misc_feature (11325)..(11325): n is a, c, g, or t
  misc_feature (11329)..(11329): n is a, c, g, or t
  misc_feature (12533)..(12533): n is a, c, g, or t
  misc_feature (26940)..(26940): n is a, c, g, or t
  misc_feature (33649)..(33649): n is a, c, g, or t
  misc_feature (33655)..(33655): n is a, c, g, or t
  misc_feature (38411)..(38411): n is a, c, g, or t
  misc_feature (38415)..(38415): n is a, c, g, or t
  misc_feature (38463)..(38463): n is a, c, g, or t
ttgcctggataaaccgactttaatatttatgattgccaagaggctgagagtccttttatgaggtccggtacctccaaacaagacgtgttcatgtagtcttcaaactggcctggagggggcagctccagccagtcggaggcgcccaggaggaaggcctggctccagcaggagggcccacagtccagtctctgttgtcggctaaagctggtcttgcgccgtcagcctctaccctggcctccccaggctctgggatggctcagaggttgccgtcattgggtttcagcaaaaataaatattgtccaggtgtccctgcctcccattgcgtcccctgtgctgctggagtgacatgctccttggagaagttagtaactctgcaggtagggtgggtggtgacaacgcccactacacgcggaagttgtacattggaggctggcgaagttgggagcagaggcatatccataggggaagctggcaggggctgggcccacggcagggcctgcagagggggaagcccacaatgagcagagctcttcctgcccatgggggtcctctcctggctgcccctgagtagcccggggcccagggagcagggtctataggaccagcccttaccacccagacgctgaggccccaagagagcaggcatccagaggcaaggagcgtggggtcagccagagaacctggcctggctagaggataagctagtctccaaatgggacacttacttagtgcaatcagctgggtctcattcatgcccatcaaaatctaaaaaaaccagaatgacattaatggtggaaggacacactcagccggacgctggagacccgccggcgtgctgcacactcacaccacaccctcaggcctgtgtttgccccacagtgtccaagcaccccacagcctctccagtctgctcgacagccaggctgccctgggcaggttctcaggtgcaaagcccctcccagcacacaccagcagcagccttgctgtccaggggccaggcccagcaggacacagcagtagttcacagctaggcaggcacccctatcagaaggcaggcatccttacagcagggaggacagcggccgtgccaacattcctgggcgtacacttctccacacccagtagccactgggatccttccagcccccacccatctattcccatccccatccaaagcccagccaggtaagggcagtgggactttgactccctccctgctccctccccagggggttgggggctacaggtgccacctaccaaacacgagaggggcaggctctgtcacatgctcctcttgcttgcgcagactctccaaggcatccagtttgtccacctgcaaggaggcaaaagcacgtgagcacccgcttgacagagtgcagtccggcctctaggtgaaagtggagtggaaggtcaggacacagggcctccaggagaatgacagtggaggaggtgcacatgggcagatgtggagtggctcagcccacaccccatgcacttttagaatgcagcaaggcatggagaggtgaagcctcggtagctgggctgagatggaacgccaggtggggcccccagagcttcccagtgggcactggggcagtcagttgttacaggctgtgcatgtggcctgcttatggggggccaagtcctcctctggatacagggacactgccacttaccgacctgcagggctggggccatgtgcagggaacactgtctgcttctggctctggccagtctagtttgcccgcccctccaaaccagcagagagatcatgtggctctcagagacaagtcacctggcacctagacacttcacctgagaagcactgaggacaaactgcctcctcactcttccctgaggcttcaccaggcactgaccccacccactgccagagagcgaggcggcagcactgcactagaggggcggcagcaactgtgcagctaggatcccctcacaaacacactgagtaagaaagagaaataagaatgtgccccccatgagctggggtctggggggggctgagaaatgaggaggaagcagggggcacacttgctgacacctagggtgagggctgagctaggcctgtaccctccctacaatgggagagcgctgggggcgtctcagagggatggccctcaagcttcccagatgagccacgaggccccaggcccagctgtccaccaggaaaggactgtgcttcttgtccgcgccctcattctcccagcactgctgtgtggtgtcagctgagcaccagctcaagctgacaatcagctcacacccccatgccactgactgggaaaccccttgccagccccctcctctccttgaactctccccatgacaggcgtctcatctgccccagcaggaataggtgggtggcagcagagaaggtgctccagcagccaccacctcccagggccagtggagtctgggaaccctgggccaaggctgtgcagccacagtgtggaccaacgtgatagtggctgctaactccatcatccgcaacagaaagggaatgtgcgcctcaaagtcctgggggatccccacaagcactttgacccccacagcaatgacactccctagggcctggtgagcctgagttcctctgacactaacccacgggcctctactgccaggaagagattcaagcactttctttccttgtgctggttctcagaacacagactactttcaggaaagacacccgagggatgggaaaacctgctcatcatggtgacagcagcttccacaggcacgcaccagacaccgcacaccacacactgcataccacaaaccacataccacacgtgccgcctgtagggagttgccatccactgtggtgggggaaccagggcccttgtcaatccaaccagtccatgtcccctggcagcccacgaatctcaggccacgtagccagggctgtcccttcctccccaacccttgagagtcatcagggagtctcactcaggcatgctatgcagatgggatggggtcacactgtcctacaggagggcaacggccttgaatggactctgggatggcctttatcaggggctgggcagccccctggaggctctgcaggcggcaggcagccctccaggctaaagctggcagcatgagcccgccttcctgtttccttcctacctcccactcacctgggaggcccctcccttccctcgctccactgagtgatgcttcagcatgagtgccttccgaggctctccatctggcttgaaggaggttagataggcaagtagatgctactggaagtagcttttccagtgttagaaacaacaaactgtaccagatgacactgctgacacaggtctctggacagtggctaaagctagatcccagcagggactcctaggacttcaacacccagggagagttttacaatcaagtactgtcacttcgatgaggcagagagtcatcctccctatagctgttagaaggattcagtggatctgtgaatactcctactatgtgttcagcaaaaggcagctaccaccaaccgtatgctaacagctgcacccccagacgccactgggagctcctcagggagctgggattgccagccacctcactgtcaccttgttgaagtccagggctggggatgagcacgcctgttgtgctcctagcagtgtgcacattgggacagctgcccagccagagtctacaggagggctgctgccagtgggcactccccatgatgattttctggaggggcttaacgttgggcagaaaaccacttcagcatgaaggaaagcagccactcctgaaggcagccagggctggctggggaatctgggttggcctcaaaggggcccacccttaagacctgcggccagagtcactgccagggttgggtcatgccacacaggggccggggagctgcagccggcccggcacctaccttgctcaggtactccctcatcacctggatgaagtagggcatggccaagtccacgaggttgtgcctccaggccagctcaagcaccatgtctgggcgaagcaggtcatagcaggtgaagagacaagctgcgaagcactccctcttgccttcctccaggaaccactgcagcaacttctgggccagctcagcatcccgcgactctgcagcatgctgcatggcatcctgcagccaaggcaaatgcttgcttgggcatcctgcaggcagaggctttgtgcctgcagcagctgggccggagggcagggagtggcactagactccaccaaggacttcctgcgctgtggagcaagcctggacccatggctgggccattccctatgccctgctgcccactggtgaaacggagatgccacctccggaggctctggaggggacaggtggctcacggaggcgcaggtgccctgggagacaggaactctagccccgagggcagagggcgtgcacaggctgctctgaggaaggcactgatgggagtttgggggttgtggggctgctgcagaggtgctgcactcaggtccatggagcgtgtgacaccaggggagcagttaggaggggtacggctactgctctagaaacagcaatgtgtttttctttcaagtggctcaaaaacccctaactgctattttcatccttgcaaatgtatttgtctaagacaatatcattgacaaaataacacctgcacctgaccagtcctgaagaagcctgcactttctgtggccattctctattttctagctccacagcaggcactggatcacctgattccttctatggcaggggctattagtaccccattcagagaccaggaacctgagacccagatgtagtcacttgcccagggccactccacctggagttggccatgatccactgactgtgacctgtgctctccagggataccctgtggcggtcccagctctgcatgcctgccatcgcctgcagcacacacctctgagttccgtttgggagacccctgaggacgcccagtgcccacatctgcatggacccgatgtgctgagctggctccggaaagaagtctcccccgctggcatgctgctcatcgatcgctgcctcctgacccacactgttcctacaaaggcaccaggattctgaccctcaggtgagagctccaggtgcctttgggtctccgctttgaggacctgtgacgcccgctcatctgtctccctgccgtgccctccaccggcccagcctacccttgctgacttgtcttccacatgtgcctaaagtgggccctgctctgttcctcctctgtgggccttggggactgtctcactgccttcccagaggacttccagtagaagcagcccccaggaagctcccagtcagtgtcccgctcctgcggcctggagcccagctcgagtcaggctctcccacaccctcctctctcatcacctccccggcccatgccactctcagggaggcttcatcctggtccccatccctgtgtccagctctccagtctacacctgtacttccgcagcccctgctcttcactggtgggtgtgggagggccccactgaccgaactttcatttaaatgctacttctgtcatctggaaatacagttttctgttgctagctggctttgccctgactggacacgctgtgacctggccactcctccaggaagactccaggaggcttcagctctggcctcagggcaggctcctccagtggcagtgctgaccttgggaggtctggggagccgcctgtgcactggggcttgtgggccccatccctgcctctacggcctatacacagcaccacgccctaagctgtgacaaccaaacattccctggggtcacagtcattcctggctgacagccactgttctgggggaagcgcgctcggccactttctttttttttttttttcttgagacggagtctcgctctgtcacccaggctggagtgcagtggcgtgatctctgctcactgcaagctctgcctcctgggttcacgccattctcctgcctcagcctcctgagtggctgggactacaggctcctgccaccacgcccagctacttttttgtatttttagtagagatggggtttcaccatgttagccaggatggtctcgatctcctgatcctgtgatccgcccgcctcggcctcccaaagtgctgggattacaggcatgagccaacgcgcccggccctgtgctcggccactttctatctgtggctttgtcctctggactctcttctgggcccacgtggctcggagtgggtggctggcaaggccagtaggcctctggcagcactgatggccctgctcactcatcactgcctgagtgttgaggaggctgtgtgtttaagcccctgacagggaccacatgggtaggacagaatggctgtgatcagccagccgagggcagccttccctcaggtgcgtctgagcccagctgtctcctcccagcagccaggtccagagacctccaggtgcggtctcagagcctcagcagcttttcctctccattccctctgcaggggccctgtgggcacctcaggaaggatcacaagcactgtcaccaagggctaggatatgtcacagaacagtccagaacactggaggtgacaacttagggtgaaactcaatgcaacactgatgcaggcatcagaggcctccacggagtctgagccaacagccgcagaccaggagccatgagaatgaggcccctgtgcgggacaggaagtggcaagtatccatgtgtcctgtgaagatactcaggaatgcctaaggccaactccgtaagtaacaccctcaggtcaagtccagagtctttgggcacaaggagcccttgggaattggctcagctgcatcacacagcacccacaagggccctcttgtacaactccacctcacccccgcggggagatgttcaggccaagcagaggatgttaatgccttcagggtcttgggggtccctccaggcagcccaacctgtctagctgatgcccagatcccggtctgagaatgatactaagaaacctctcaccagcagaaaaaacacagtttctttttcctctcaagtgatcctcccacttcagcctctaaagtagctgggactacaggtgcacacaaccgtacccagctttgaaacaaatgttttgaatgtgatttatttatttttttcctttttttttttccgagacagagtctcactctgtcacccgggatggaatggagtggcgtgatctccgctcactgcaacctccgcctcctgggttcaagcgattctcctgcctcagcctcccaagtagctgggattgcaggagtgcaccactacacccggctaacttttgtattttcagtagagatagggtttcaccatattggccaggctggtcttgaactcctgacctcaaatgatctgcccacctcagcctcccaaagtgctgggattacaggtgtgagccaccacgtccagcctttgaatgtgattttaatttaggtttttaaattcctcaaatctttttttttttttggagacagggtctcactctgttgcctagagcagtggtgtgatcatagctcactgcagcctctgactcctgagctcaagtgatcctcccttctcagcctcccgagtggctggtaccacagatgtccatcactacacttggctaattttttgtaaagatggggtcttgccatgtcgcctaggctggtctcaaactcctgggctcaagcactccacccacctcaacctcccaaagtgctgagattacagggaagttcccaaatcttgataggaagtaaagtaggtgccaagaagtgaatcttgccacactgtgttttggtagagtgaaactcacacaaaactgctgcgaaaagaatcaactccgtaaaactctacaagtctttcaatccaaacagtttttaaggggtgctagctcactcccaattcttactctatgttctaaatatggtctcccattaatactaatccccccacccaccacgaggatcccctggtgaagctcagagccaggtctcaggaacaagagggaagggatgtgacccccaaagccatcaggaaacacaccaaggcaggaaggtgggaggaaacgggcccaggccaccaaccttgtagagatgatccttcttgcagagctccacgctctgggcccaccagttattgcccttgtacagataggccgcaatgcacctgaactccatcagctgatgcttctccagctgctgagccaggctgatgttgtcaaagttgtcataggcatcgatagatgcccttaagccctaggaagacagcctttctgtgagggatgggacactgacatgggctgcctacacatggagcaggcaccttgtgttacttgatggctgttgctatcagcacagccttagaaaggcccctgcccatatatccactggtgtcctgtggggcctgcacaccctcctgtgcaaaggcagcctgctttgagaacagaatggcagttgcaggggaggagcccagcccacccaggacagggctccttcctgcacacccacctgatagtcctcctcctctgtcagcaggtggttgagtgcctcattcacactcttgttgttgtggctctggactgaccgcaggtaaggcttcaccaggggcagctgacctgcctgacaagttgagggaaccgtcaaggcacttggccaagcttgttatggggacactaggcaggggcacaggtgggcacgtgcgtgccatccacttgaatggtccagctctggagccaagggcaccttctggacacctagaaccaaaagacctacactcacacaaagaggactgtctgggcgattcagtggatgccaatgtcaccacagacattcacaccttagagagacacatgggtttgggtccagaccaccacaataaagtgaacattgcaataaagtgagtcatattaattcatgtttacactatgttgtagcctaagtgtgtaacagcattatgtctacaaaaacacagtacacaccttaattaaaaatattttagtgctaaagaatgctaacaatcatctgagccttcagtgactcgtaatctttttgctggggagggtcttgcctcaatgttgatggctgctgattcatacaagtggtggctgttgaaggctggagaggctgtggcaatttctttttcttttttttttttttttgagatggagtcttgctcgtcgcccacactggagtgcagtgccgtgatctcggctcactgcatcctctgcctcccaggttcaagcaatcaattctcctgcctcagcctcctgaatagctgggaccaggcgcttgccaccacgcctggctaatttttgtatttttagtagagacagggtttcaccatattggtcaggctaagtctcgaactcctgaactcaggtgatctgcccacctctgcctgccaaagtgctaggattacaggcatgagccactgcgcccagccggcaatttctttccttcttttttttggggcgggagacggagtgcagtggcgcgatcttggctcactgcaatctctgcctcctgggttcaagcgattctcctgcctcagcctcctgagtatctgggattacaggtgcgcgcccaccacacctggctaatttttgtatttttagtagagacagagtttcaccacgttggtcaggctggtctcgacctcctgacctcatgatccacacgccttggcctcccaaagtgctgggattacaggcgtgagccaccgcgctcggctggcaatttcttaaaataagacatcaatgaggtttgcctcactgactgactcttccctttatgtaagaccactctggacttgtgttgcataaaacaaaataaactaaacaaacaaaaagactctgtgcagcatgcaatgctctttgatagcactgtactcacagtagaacatttttcaaaattggtctcagtcctctccaaccttgctgccactttatcaaccaggtttatgcactattctaaatcccctgtagtcatttcaacaatgttcacagcatctgccccagcagtagattctatcttaagaaaccactttctttgctcatccctaagaagcagctcctcatctgttcaagttggatcctaagattgcagcaattcagccccttcttcaggctccacttctaattctagttctcctgctgtttcccccacatctgcagtgactttctccactgaagtcctgaacccccaaagttatccatgagggttggaatccacttcttccaaattcctgttaatatatggatattttccttatatactggtgtctttacttgtttccaacttcttattgatacatgatagttgtgcatattaattgggcatatgtaatattttgatacatatacacatgtgggatgatcaaatcagggtaattacgatatccgtcacctcaagcatttatcatttctttgtgttgggaacatttcaaatcttctcctttagctattttgaaatgcacaataatttattgttttttttgagatggagtctctctgttgcccaggctggagtgctgtggtgcaatctcggctcactgcaacctcccgggttcaagcgattctcctgcctcagcctcccaagtagctgggactacaggtgcctgtcaccacgtctggctaatttttgtatttttagtagagacggggtttcaccatgttggccaggctagtctcgaactcctgacctcgggtgatccgcctgccttggtcatccacccaccttggcctcccaaagtgttgggattacaggcataagccaccattcccggccattaattagcctaattccaatgctgttgtgtctcagggaatagggaggcccaaggaaaggaagagggaccagggcacggccagtcagcggagcagtcagaacacatacaacatttatccattaagtttcccttcttataggggcatggtttgtggcatcccaaaacaattacaatagtaacatcaaagattgctggttgtgtgcactggctcaagcctataatcccagcactggaggaggccaaggcgggaagattgcttgaggccaggagttcaaggttgcagtgaggtatgaccatgccactgcactcccacctgggcaacagagcaagactgtctcaaaaaaaaaaaaaaaaaaaaaaagatcactgntcacagatcaccataccatntnnngnncnaaaatttgaaatattgtgagaaatcctaaaatgtgccacagggacatgaggtgggcacatgctgttggaaaaatggtgctaatcgactttctcantgcngggttncaaacctccnatctttttttttttttttcttttgagncagngtctcacactgtcacccaggctggagtgcagtggcacgatcttggctcactgctagctgtgcctcccgggttcacgccattctcctgcctcagcctcccaagcagctgggactacaggtgcccaccaccacgcccagctaatttttgtatttttagtagagacggggtttcaccgtggtagccagggtggtctcgatctcctgacctcgtgatccgcccgcctcggcctcccaaagtgctgggattacaggcgtgagccaccgcacccggccacaaacggctaatctttaaaaaaacacagaatttgagaagcacaataaaatgaagcatgatacgggaggtattcctgtatctgaaacctaaaacactttgatacactggtgaatcttcaagtcagctgggggtcatttcaaaaactctttataaaggtgctatcattcagatgactttgttagagctagcccaatacactcttctacctggggttttggttgactcacctttgaaaagaaactgactgtccaggtgtggtccagccggggtgaaagcaccagcagcaggtcattgatgagcagtggtttgtaatccaaatagaactgcagggctctgtaacagagctcgacgttggcaacctgtggtgagcaaagctgagggtcagtccctgccgctgtctccagataccccagggctccttccagtttttgctcaaatgacactttactactgaggcctgccatgactaccccctataagactcaatggcctgtgaaggtgcctcctctcatccctgaggtattttgtcccccagcactgacacactgagcatttttcttaagaggccagcctcagggtttcctgcctcaacccagcacctagaccagtatctgatgcagggtccacgatcactcagtatcggctgaatgaatgaagtgtaatcagtcagaatgaagccccacagcaaaaccaaacaacagagtatgtttccatccaagcaagattactccagctttccttggaggcctcagcctgagccataaccaagtggacagcatgtcctgtgacatcaccagagcttttgagctgaaacactgtggtgctcagaccctgggtgagacctgaaggccagcccatgcagagagtggaccactctgggtggaccctgtgcctgtgctcctgggtctcgagatttggccaggctgctgtntctcttagcactttccccactggtctgccaccattctcttgctgggcgatgtcatcttttttttttttttttttttgagacggagtctcactctgtcgcccaggctggagtgcagtggtgcgatctctgctcactgcaagctctgcctcctgggttcatgccattctcctgcctcagcctcctgagtagctgggactacaggcagctgccaccatgcccggctaattttttgtatttttagtagagccggggtttcaccgtgttagccaggatggtctcgatctcctgacctcgtgatctccccacctcagcctcccaaagtgctgggattacaggcgtgagccaccgcgcccagccctggcgatgtcatttggtggcttgctgactgtggcatcgatgtccagggcctggacacagctctgttcagggagcatgcaagccagatgggcatgaaccaagacagtggtgatgaatgtgtctgcgtgagtgtgggggtcccgggatgtgcacagggcacagctggagctaaagtcatgctgggatcccagggtgatcaccactggagcctccagcactgctgggtttgggtgacctggcaaaaatgtggggcccgatggggtcttctgactaaaaggggtctaatggtcccactatggcttactggccacttcagggtgtcttctttctccttctcttttccttttgtgctagagcactcactgtcaccagagattctgacccagacaggcagcagggtccctagtacccgccaccatggattcagagcaaaacggtgaactggccgcatcacaaagcttcacctatggcactggtgggcccccagactctgccacaggccactgtgggtccactcctattggagctctagcacctgtcagccttctaggctggccctttactcagcagcagggccaggacatgggggcctcaactagacactgaagaagcagagagcagtcaggatgtgatgtggggctgaagagaagggtagggactcaagttcatcttctgtggcgaatcacctcctcaaagccccacctgcttccccaccaaccacaaggctcctcaggcctcccgtgaaggagaggaaccatccaaggacaagcccatttcagagactcttgcaggtatcacgcgagtggacagacttgaagtggggcaccagcagtcctagcttcccttgtgggacacctggtaccatgtgcactcttggccctttcaacaggtccatgcagcatggccggaatgccgtttaaggtggagtataactgccatgttcccacccagttcctctggtgttgaggcctgcagggacacacatctctgttgggctcagctgctgggatctggagccctctgcactacaggaggaatggagcggcggggcccctctggagcgtcctccagatccaagctgaaagacaggatggggtgagtccactagccacgcgccaggacatggagcactggcaggcccgtgcccactagcatggtcagcaaggacagccagcaccccagaagacatggtagtatccctgttttatacaagggaaaactgaaggctgggcgtggtggctcacgcctgtaatcccagcactttgggaggccaaggcaggcggattgtgtctgtaatttattccttccggtgggttcttggtctcactgacttcaagaatgaagccacagaccctcatggtgagtgttacagctcttaaagatgttgtgtccagagtttgttccttcagatgttgagaggtgtgagtttcttccttctggtgggttcgtgatctggctgacttcacaaatgaagctccagaccttcgcagtgagtgttacagcttttaaacctagtgcagactcaatgagtgagcagcagcaagactgattgtgaaaagcaaaagaacaaagctcccacaacatggaaaaagacccgaacaggttgcactgctggctcgcatggccagcttttattcccttatttggccccacccacatcctgctgattggcccattttacagagcgctaattggtccattctacagagtgctgattggcccattttacagagtgctgattggtacgttttttacagagtgctgattggtgcatttacaatcctttagctagatgcagagtgctgattggtgtacttacaatcctttagctggacacaaaatttctccaagtccccacccgacccaagaagtccaggtggcgtcacctctcaagatcacctgaggtcaggagtttgagaacagcctgcccaacatggtaaaaccctgtatctattaaaaatacaaaaatgagccgggcgtggtggcaggcacctgtaatcccagctactctggaggctgaggcaggagaatcgctcgaggctgggaggcggaggttgcagtgagccaagatcgcgccactgcactccagcctgagtgacagagtgagactccgtttcaagaaaaataataataaaacaaaaaaagaagagaaaactgaagctgagattccgccacaagctccaggatagctggttggcgtgctgtgctgcacaacctgaaagaagcgcccaccggatgccaggcacctgccatggaccacttggtcgggaggaaacatgatgtccattgtatggatgggataacgaggttcacagcggtgacacccctagcccacatggagagagacagtgaatggctgagctggggtgccccccgtgtgagttagcaagctcccctgctcaggctgctgctggcccagccctatggctaagtggattcctgctatcgtgtgccccaaatacagattggatgtcgtccatctgattggacccctgcactggcgagtatcctcctacccccttcacacctgagctgacagtgtctgtctcccacacggcagggtgtagtagaagcatcatgaatcacacaaggaactggactcagccatcagccctgcaggcaccagatgagagatgctgctctcccacacagtgagtctcagctgtcctgctattattttatatgccagtaagaaacaaaagcatggccacttccaccacggctcagcaatttttaaaaacaccctaatatcagaggagttacaatgtgaataaaatacacacaggattgatcaagtatggattttccagcacacagacaaatctacaaggcagcagccacgtgtgccaggccacagtaaggtatgacctggccgcactccctccagcaacctgcagactctgctcagggtgggacgccccatcaaaggcccccactttcacgtaccaccatgcccagtaacatggatgtcctccaacaagaagctcgggcttgtggcctggtgctcaatactgggttccttcaaatagttcccaggaaaggcagaggctgaaggctcacctggcagcacacgtgccactcgcgcccaccctcagtagccgcatgtggaaaagaggtgcatgagcgaggccacagctcactgctgtgccactccagtcacaagccgactgtgacaagttagttacccaaagaccatggcacaaagcgcagatacccaatgcaaagggatgggggctgaggataaagaattccagccccttcaccaaactcacatacagagctggagaggggtgggtcctgaggttgaactctctaagagaccggaaacaaaataacaaaggctcacttgaccatggcacccaaacccgacaccacccaacagtgtggctgctgacagagaaactcgggtcccggtttagcccagttaggctacaggatggaggcccactcccagacaggtaaggccgctggtgctggggagagacatgaactaaaaaaaaaaaaggtccgatggtgaacaataaccacaggaagtgggggtgggagccctgagctgacagggcagaaggaagaacgaactgaggcctggccacaagggcgtggtatggtgggaggggcgggcaggcagggccacagggccacggctgcatgctggcctgaccctgcccgcagctcagctgtgcatcgctagacgggtcacctgcccttcttaagtgtcagttcccttcaaagatggaattactaccatctgcccagagggtggtggactcatacaagtgaacgcacacacagcatgggggcatgctggtactcattccactcccacctgcccattcccctgcacccagaatagggcctggcagaggctggcaggagccagcgctctgtatcccctcttaccttggtaatgatgtccttgaactgaccctccttccaggcctcagtggggtggctcatcatggtgagcacagcattgtcatactcctcgtacttgtcatagaggaacaccagctcagcccacaggtgtgcctgctctgcagccctcagcacctggacaaggaggtcagggtcggcttgtgctgcacgtggccacggctgccagactgcaaggagtacacggtacctttgggatgttgacacgggaccagaaaagctccagatgctccagcatcttctgtggcttgaatttggagtagaggatggccagctcagtgaacatgcccatgtgggcccgctccaggcccagggccgcttccaacagcaagatcagctcctcaaagtagccacgatcctagcagaccaacagccacgcgtggggcagagtgattgcatgcctcctgcagccaccctccagcccatgcccacgccgcagggactgtgcttgtgactgggaatgatcccgaggaggcatgtgtgaagaaaacgtgtatacatactgtgctacagatcatgccatttacttagcaacttattggatcatctgacaattaccagtggcacactgcactacaattttcaagtttagtaagtgcaaattagtattgccaattttatttaaagaattagaaaaaaaaataggaagtgggtggtaacagggtctgggaatgatttgttttaatcccttgctacagctcattactgagatcctggctccaacaaaccttcaactccactcacgatgccacgtggctgttgtttcactgtgtccctaattatgatggccagccccttgcattcagccccacacgcctctgacactctccctggacaagaccagacgtctggttacagcctgctcagcatgcagaaagcctggagaaacacccagccatgtgaccctttccctttactctaacgaccacagccctgggagggtccgacctagaggactgcctcacacctcttgttttcccaaggaggacacccttctgtgccccctccactctcagactaacctcatttcccagtggcacacttgtctgctggcagcatctgcaccccccaatcagctacagacacgccgcctgtgctcctgtctggaacctgcccagcctgcagctccatcccacctgcttgcctaccaaggccacagctccggtgactcctcatttctcttctgccttattttcactctccacagctgggttcagcaagcatcccgctcatcctcctatcctaaacaccctcttgacccgatgtccctgctagctacctcccattttttctacttccttttgcagcaaaaactcctcacaacaaccattcccattcctctccctgttctctccagccaccatcaggctgagtctctcccaagctccaggtcacaagcagccccctggccctgccatcctgctgtctgctcagcagcaggccctgtccctgctgaccggcccctcctctccagtgcatccaggagccagcacactctctgggttttcttcccactgtactggctgctcctgctcccctcctcagcccacccctgttgggcagtctggtcttttcacctacactcatccccaggggactgcaggcaaacatagatggatgtggatcacctatatgtcagcaactccaggttcactgctctagctaggcccctcctctgtggagctccagatctgtctccagctgcctacatgatgcccccacctgaacatccagcgggcagctcaagacttagcaccatgtgtccaaaaagtaattcttgtccttccctcccgtgctgcaccttcagtcttcccctcatccactggtgataactccgttatttctacttattcaagccaaaaccaaatggagttatcctgggcttttctctctcactccacatcagtgcattagcatatcaaggtggctgctcattcaaagcacacacccaatcctgatggcctgatcacctctcaccctgtcaccaccaccctagtcagagtcactgtcccttctcgcctagaccactgcaacagcctccagctgctcttctggctcctgtccctactcctcaagtatgtgtctcagcacatgagccaccatgatccttttacccccgacagccctgcacccatcccaagtacagcccgtgaccttcctaacggcctgagatctggccctccgtcagcctctctgccccatctctggctccagccccttccttgaatacacagcacacttctgcctcaggactttgcctggccactgacccttccctcaaatgttcccatgaccaaatccttccatttcttcaggtctttgctcaaatgtcaccccctcaattgctgctaccttgaccgcccctttatgaaactccatccaggcactcctatgccctcaaaccggctccattttcctctataactgatcaccttcaaacacactatataattattcattaggtttgttgcttgcctgccaaccttgctgaatgccagttcaattaaatagaggcttttctgttttgttcactgacacaattattgagaataatgcctagcacacagtaagtactcaaagatttgctgactaaattgttcttttgtcagccctgtactgcttgatcaccctccctgttggctttccagttcatttctcaggcgcctctctgggggtgggaaagcatttctcattgaaaagccatcacacccagctaatatctggacactctggcgctggtgcgagcccctccagacaacgtctcacatagtgaggggtttggggctcaatttccatggccatggtgacactgctgagcagagtcagatcccatcttcgtctgccttgactaaccatacctggagttgtcatgtggctctaggaatcccacaggtggaagcccaggtccctaaacacacaaatcactgtctaccaaccactcaagagagcctacctacagcatgaacatacagggccccacccttccaaagggtccaggtggggttccctctcttgcctgtgctttgtccctaaggcacttgaaaaacagactactggggctgcacactgtggggaactaggctatggactagagctctgccaccaccagcccagtattctcagcaaccctccaagggttgttcccgtcatgcaagccactgactgggcttctgaaggcccaataacacaagaggatggagagaacttaaaaaacacaaaattccagccagccatgaggtcgaggatagctaacaaggcaattgaatttagttcataaatgactgtctaacacatgaatcttcccctcagggccatgcttcatatttgcagatgcaacactgtgatggtcacgagctaaggggatgaccgtgcctctctgtggagtgtttaggcatcacttgtcatctgcattaccagcagagatcatctggtcacctggtaatagcacatcagctcctccagctcatctgcatgaatgacgatgtgaagaccacacagctgtgcgaagcggaactcttgtccatccatgcaggcaaagcacacctaggggacggagggcaagcgtgagggtccccaagacaggacacagcaccacagcagctgacttacaaggcacacagttgcaaatgcagaaataccagcagtggggtattttaagttggattctgaacaagtagctaactctatgatgaattgtacaagactgggagaaaaaatatgacatttgtaatctgcaggccaagggggtgcttgagaccatggaaagaataaagtttgtgcattacttcgtaggccctgagttttgttcaggtggcgggaaagtcatgctggaatttcaggtttggggtttgaaaaggaaggctaaaaaataatgaccatcagaatgcatctcatctgagtgttgttttcacgggggagcttgttttaatagttttttagactacttttgttttctgcactgtacagtatgtatacttaatgataacaagccttgagaagtgcagaattcccctgtacaaaaataatcacataagccagtgtcattaacttgagatataatctttggcccactgtttcctatgtgtgatgcatacaccagcaccctgacaaatttcccacataaacacagtggaattacatcatacattctgcatgatgatatattcctcgcataatattggcaacatcttttcctgcaactctgcctattcatcttaaacagcagggtagagttgtaatgcatacattaacaaaggccttggccgggcgcagtggctcatgcctgtaatcccagcactttgggaggctgaggtgggtggatcatgaggtcaggagatagagaccatcctggctaacatggtgaaaccccgactctactaaaaaatacaaaaaaattagccgggcgtggtggcgggcgcctgtagtcccagctactgggggagctgaggcaggagaatggtgtgaacccgggaggcagagcttgcagtgagccgagatcgtgtcactgtactccagcctgggcgacagagctagactccatctcaaaaacaaaaacaaaacaaacaaacaaacaaaaggccttgacattagacctttaggctaattttaatctttcattaaacaatgctgttttggatatttcttcagttttttctacttgaagatggattctgatattatcagagagcctccagacaatttaccaatttgccacaaaggaccaataatgtaaatttacactgattatgcaaataaggtgacatgatttaaaagtgttatgaaaatacttataatactggtaattccatgctattaaggctacctctgggggccaactggttccacatcagattctctggggcctctgttccaactacaaacactagcctagagactctaagaatcccaagggttcagacccctgcctgggcaagagaccggcacccagaagagtaccgagcagaacgcaaaggacacggagagcgtgcctgtccagcacactctgccgtctgcagttgcccgcagctcacctccttccacgtccgggtgctgctggccttgcggctgttgtccactgctgcctgatactcaccgaggtgaaccaaggtggaagccaggcgggcaaagttagaaacattgctatagagcagcttggcagcctcgtacattccctcctcgtaacagcggtctccaactacggataatagggtagctcgactgagacactcttcaatgggaagatttctccagagttgcttttaagttcctagatggcagaggtatttttctgtttgctagggtggtaagcatctttctgatcgcaccagtgaccagatgaagttggccttggctttctagtccctggacaccctcctccacctcagggggcgcttctacctgcccgctcctatctaaccctgcgttctggcacctctcaggccctggctgtcacctaccacatctgcaccccactgggcctgggctgaggaggtgtgctccttgctgcttccaagccgttccccttcctcctcaataaaaaccgttcacaaccaatcttgtgtcaggtatcactcaccagccctagttcctgatgccatttacaaatctttctcattctctggcaatttatttgacttcctatgagctggggaccttgttcttctcacaagaacaagtcactgccatagccacaccttacacctcagaagagagatgccagccctgggaaccttccacaagtacctactctgcctagcactgcccagctcgccatcctgagcgcctcaactccaccagtccagtgactggactgaattcctgcagccctgtccatgcccaacttgcacttgccccagctggtggccccagatcatgctggacagctcctggcattcactcttgactctcctgattgttctcagtcctgctcagagctagttctctgcccattccatacctgtggctgcagagctaaacacagacagcagaaccccaaagtgctgatgggtctctctaaattcatgaaggctaacatcaaatgcactggcaacactacccatcctacttccgccatccacagcacctcccgcaccaaccctccttccgccatccacggcacctcccgcaccacccctccttccgccatccacggcacctcccgcaccacccctcctttgccatccacggtacctcccgcaccacccctccttccgccatcacggcacctcccccaccacccctccttctgtcatccatggcacctcccctccttccatcatccatggcacctcccctccttccgtcatccatggcatctactgcactaccctacttccgtcatccatggcacctcttgtaccacccctacacgcctgtcatccatagcacctctactgccacccctccttccatcacccatggcatctctcatgttaactctttcatatctccttctcttctcaaagctctaacgattcctcaagctgagtatttggcttcccttttcctgagaaaacaaactatcaggagagcctttcacagcacagtgtccgtggaatgtccttcctatgccaccaaggcctgctccatggatgtccctgaccccctctccacatgctccatgtcagggtttcagcaaatccctgcatcagcatccatcaccttctgcactcatccactctgacaagcttaaagaaccactgttcttttctctagtttaaaacaaaacaaaactggccaggcacagtggctcacacctgtaatcctagcattttgagaggctgaggcaggtggatcacctgaggtcaggagtttgagaccagcctggccaatatggtgaaaccctgtctctactacaaatagaaaaattagctgagcgtggtggcgggcgcctgtaatcccagctactcaggaggctgaggcaggagaatggcttgaacctgggaggcagaggttgcagtgagctgagatcgcaccactgcactctagcttgggagacaagagtgaaactccatctcaaaaataaataaaataaaactaatccaacttgctctgccctcaacttacctgggggctgtcagcctgtttccatgcttcccatcagagcacagttctcagggagtatctgtgtgtctgtaacagttgtcccctgtcttcctattctctctgcaatccactccaatcaggcttctgccagcctctctgccagggtcactgctcctccagacagacgcagacatggttttctggacacccctgcctgcttttctcccaccccgctggccagtctccatctccccctctccctgctgtggggctttggggtgctctggcttctttggtccatccccccccagccccacacccccactgccatgctctcccacacaggtggcggctgtgggtgctgcctgtccctggaggctgcccatgcacatctctagtctgggcttctcctctaaaacctaactcctacttccagctggacagatccacatggcatctactagaggtccgacttgtccgaatattagtcctgatgcccccaggcagtcctcacacactgtccccacactggtaagcatgactgcccacacccccaagcttgacccgccctcactgcttctctcctcacaccccacttggcagcacgccctgccggctctgccttcaacacacatccagaagctgactatgctttgcacttgccttgcccactttatctgctgtcgctgccccttgcgacatcactgcaccatcctcctctatgcactccctgctccacccttgtccttcactctgtttgtagcatagcagccagaggggttccgctgacccctagaccagatcattttcctcctctgctcaaaatgtccagtctcgcccagagcagaagccagagaagccagagtcctgatgacgacccctgaagtcctgacccgcagaggccaacagctgcctcttcctactgctccccaagcctctctcgctggatggctgtgctccagccaggggctcctgcaccccacaatgctcctcacaggatccttgcacttgccccgctgtcttgttctaagggctccttcccagaggtgtacagactcagcacttacccaggggccctttctaaaaccagaatgtccactgtcacacccacaccgttccaacgcttcttatccctgccccgcttcacttagctccttatattcaccatttaatagatcacagtatttttaagaatcttatgattcacggggcagaaatctgattaccattttccctgctacatccatagcccctactctggcacacagctagctgatgcttaataaaaggtgatgaatgcataaatgaagtattctatcaaaggggtaagcatgtaagacttgttactgccaatttacaggaaacgcagggaaaatgagttaaatgacattgtggagttgcagtcagcagatgccagactgtgggaaacatacacaaaccaggcgatgggctgggatctggcccccaggctgaaggttactggcccctatctcaggggagtgacagcagaaggcagagagcttgccaggcctggggccactatgaacataggtaaagagccaggtgtgcctctgccccacccagccggccctatgtgagggagcttctgctctggcccacagcgcctctgactcaggagaaccctgttactaacccagagggggattgggggcaaggctttgttttctattattttaactactttttggattataagggcaatttctaaagttacatgatcactgattaaaaaaaaaaaactttgcaaacacaggcaagtaaaagaaaagcaatatgatattgccaattccaaatcccagagttattcactgtcctcatcagtattatactccattgatggatgttgttatttaactatttcttggccgggcacagtggctcacccctgtaatcccagcactttgggaggctgaggcgggtggatggtttgagcacaggagttcgagaccagcctgggcaacatggtgaaaccccgtctctaccaaaaatacaaaaattagctgggagtggtggcgtgcacctgtggtcccagctactcgggaggctgaggtgggaggatggcttgagctcaggaggtcgaggatgcagtgagctgagatcgtgccactgcactgtagcctgggtgacagaggagaccctgtttcaaaacaaaacaaaagcactatttccttttgccagacattggcttttgatttttatttgcataatcatgctgcaatgattaaatatttataggtaaaactatgtggatcttttctactttcttgggatagatttttacatctagacttagaggtccatgtttagaaataataaaactctatagctatatttcaaatatttatgtattagctgaactgatattttcctttatgctttcttccactgcttacatgtttaaaaattcctttctcatgcaaaaattcaaatacatatttttaaaaaattttaaggaaaagctcaatttttacctttaattctttcatctggaattttacttggttacagaattacatgatgaacttttaacacctttcaaaactttaacttaatttccaaccattgttttttttttttttgacacaggcttctcactccgtcacccaggttggagtgcagtggcacaatcacagctcattacagtcttgacttcccagcctccagtgagtctcccacctcagcctcccaaatagctgggactacaggatgtgccacaatgcctggttaatttttgtatttttggtagagatggggtttctccattttgcctgggctggtcttgaactcctgacctcaagtgatccacctgccttggcctcccaaagtgctgagattacaggcccttcacccccttgttttctttttgtttgtttgttttttaaagacagggtctcgctctttgcctaggctggagtgcagtgccccgatcacagctcaccccgatcacagctcactgcagccttgacctcctgggctcaggtgatcttcccacttcagccttccaagtagctgtgattacaagtgcatgccacacactcggctaatatttttnagttttttgatagagatgggggtctcactatgttgtccaggctggtcttgaactcctgggctcaagtgatctttccacctctatctccagagttgggattagaggtgtgagccaccgtgcccagccccaacaactacttggaacttattttgaaataaaaagctcaaagttcattttggttattttttttctttttcctttttagagatgggggtctcattatgttgcccaggctggtcttgaactcctgtgcccaaacgattctcgcacttcggcctcccaaagtgctgggattacaggcatgagccactgtgcccggcccactttgttgttattcatttcaataaattgcatgcgttcctccaagaagtgcacttgtaactaatatagagttataatacattccattatctcttcatgtctctgcatcacattttccaagggtaacatcttatctacatggcggactccacaattatttagatcttttatttatggttaaggtttatttaaacattttggctttattcctattaaaaaaggaatgttttcttccccattatgttatctgatttttggtgacataaactactaatttttttttttttttttttttttgagacggagtctcgctctgtcacccaggctggagtgtagtggtgctatctcggctcactgcaacctccatctcccggattcaagcgattctcctgcctcagccttctgagtagctgagactacaggcgtgtgccaccaggcctggataattttgttatttttagtagagacggggttttgccatgttgaccaggttggtcgcaaattcctgacctcaggtgatccacccgcctcatcctcccaaagtgctgggattacaggcatgagccaccatgcccagcctattaattttcaatatatattttatgcatccagattattaactctgactcaattaattttgttttcttgtagtaaacagaacgcctggatgtaagtcttcacatctcttctaggagaattattctgatgtgtatagccaagagcatgtcaaaattccatgggtctcaatttccataccaataatagcaacaggttacttacttcctcgtgtggcttgcttctcatgatctttatctgcatcacactaaagcagcggtccccaacccccatgccacggaccgctgctggtctgtggcctgttaggaatcacgccccatagcagcaagtgagcagcaggcaagcgagtgaagcttcatctgtatttacagctgctcctcattgcttgcattactgcctgagctccgcctcctgttagatcagcagcagcattagattctcacagagcacaaaccctattgtgaacagcacacgcgaggatctgtgttgcatgcttcttatgaaaacctaatgcctgctgatctgtcactgtctccatcatccccagatgggaccatctagttgcaggaaaataaactcagggctcccactgagtctacattatggtgagttgtagaattatttcattatatattacaatatgataacagtagaaataaagtggacaataaatgtaatgcacttgaatcatccccaaaccacccccgacctgtctgtggaaaaactgtcttcgatgaaaccagtccctggtgccaaaacagctcgggactgctgctctgaggaacatccctggacctaaatctgactggcagtgcacagcccccagggggcatggcctacctgctggatgtgggcattgttgggtccattaataaaatcttctagctcagaaacacggctggttttagccaaggcaaaaataagttcagtctctatataggactcacggccctttttcctggccatctgcagaaatttaactagatcctcccagttgtctaaagacagaaaacaaagataggttaacccagagctgataattttaaacaagggctcaattcctcccattctgttctcagccagacacatttaccctccagttatgtctcactgggaactcagactccagataacgtctaggaggtcttgattatgctcactaagcagatccatagctcagaagggaggaggggaggggcagagccacactcaggccacctcccttagaaaagactttgccaggagacagaatgcttgttctggacatcagagaggtcggtgccacaatcaacttgaaacaccagaagatccctgggaattgtgggcctgtcactcactttaaaattactacagtggcgatattgagatatctagtgtgcttaaatgacctcatcttgtaaaggagggcaatagtcaactaaagagctggtgtcaataacagaataatgtttatctcagactcttgtgggaaactttcatgtagatgtgccctctgatatctctggatacatcatacgtagagatttgtgagaatctcttcaacttcttgcttcagccaggttttgcatcagtgagatgcagagccctagggagaggggactcacttactgctcctgctggctgactgaacaacttccaggtaagaggaagggtcgtcccctctgatataggagttgatggcttccttcaccaaatctttctggagctgggcttgggccagctgactccacacagcaggctcattgcatctctccgcaaactcatatgcccggtccaggtttccaatgtgctcgatcaggacctaggggttatgagaggacttccattctctgcaacatctagtcagctccaaaaaacagacacatttttgtttggtttcctgttctgcctaaagctgcatgaccatttcacttcagtcagaagcaatcaggtactaagcatttctcagatggacaggttgagggaagagacaagagctattatatgagaagggggatgccgaacaaagaagagacactccaataaagaggcacagagatggagatagccaggttaagctttctgggccgggggtaggacatgggacttgctcctgaccttgggaggaaagacagtgcaacagagcatagaaactgtaaaagagttcacaagaattgctgtggggaataagattgctcaccaggcagaaacaggcttgctgagcagtctggcagattgcgtgacagtgagggccacccactgtatagtagtggaggtggtggcagtatcagctgccccctaatatgatgagctggtctgtctcaaagcaaggccagagcccatgagggggcacaaaagaagggctcctggattgggggtttcacagcaggtatagaaataaggtaaaggaagaggcaaggacataaagataattggtaggacagcagttcaggtgagatgtcctgtggtttacaactgatttggaaataaaaccagaagaggctcatagactggaaagaaagggatgcagtttaaagaagaagagttcttgaggaggcagaggggcaggcagggagggctggagggcctgctctgggaacctgaccttggatcctgaaaagctcctgctgaggagatgggggaatggggagtatagggggtgagtagcatggtgcagagggctggaatggttgtcattgagggtaagatgtgagtgcctctgaaaatcaaacgtttctgtcacctgggctgaccgatgacattgggtcaggtacccaagtccaagggagtgctggggagtaatagggaaggggcagactaacagccaatggaaggagcacccacagagaaggtcaagacaaggggccagcgggctgggaagatgggttgctggtgaggaacagagaagagcacgaagagatgcactggacaaccagagggtctgacacccttggagaggacaagggcttgcagggcgcactcatgatgtggcagaaggtgctaggtccgacatgcttacactcagcagcccacctggattgctgaggcattcatatcaaacttgtggaaaacggtgaaggcctcctcatacagtgcgctgctgacagcgatgctcgcgatgtccagtgcgtcatagttgtccaggcggctgatgtactccatgacccgtgtgcggtctgccttgatggcagtcaggatcaacagattctgtagattcctgaggagagagggtggtcagcacggcatcccaggaacgaaggctgcacaaaccattttttggcaggtcaggcatccccagacccccagtttttttaaaaaagtaattaatatacacacacataactgctaagtaaatacaacagagtatttgtgaagtatttgggatctaaaaagaaacagtatagcaaagtcttgggaaagcacaggtaagagaatcagaatgtgccaatcaaaccactgggagggctgctgtggctttttagagcccagcctctggatcctgctgtagaggtacctattttcctacctgtgctttctttgtgattcattatagctttatcacatctactgtatttctaagcaatataggcagctttgcatttttttttaactttttaaaaattttgagacggggtcttgctatgttgcccagctggtctcaaactcctggcctcaagtgatcctcccaccttgcccccacaaagtgctgggattacaggtgtgagccaccacaccaggtcactttgcatttcttgaactttcctttgctttaattataatagatgcattcttgcaaaactttatacaattcaaaaatgtggaaaaaaaatcagtgtaacacaccacatatcaataatctaaaaaagaaatactacatctttatcaaatgatcagaaaaagcatctgacaaaatctaacacctattaatgagaaaaactctcaactagaaatagaaggaaacttcctcaatctgagaaagtacatctacaaaaagcccactgttaacatcataagtaacagagtctggacactttccccgaggatcaggaacaaggcagggatgtccactctccacacttctatttgtgctggaggttctggttaaggcatttaggcaacaaaagaaacaaaaagtttcttttctataatgaatcgcaaagaaagcacaggcagcactagattaggaagaaataaaactgtccccggtgtctcacgcctgtaatcccagcactttgggaggctgaggcgggtggatcacaaggtcaggatatcaagaccatcctggctaacacggtaaagcccgtctctactaaaaatataaaaaattagctgggcgtggtggcaggcgcctgtagtcccagctactggggaggctgaagcaggagaatggcacgaacccaggaggcagaggttgcagtgagctgagattgcgccactgcactccagcctgggcgacagagcaagattgcatctcaaaaaaaaaaaaaaaacaaaaacaaaactgtcccaatttgcagccaacatgattgattaaaaaaaactgaagaaatctacaaaaaaaaaaaaatccaataaatgagtttagcaaggttgtagaatacaaggtcaacatacaaaaatcaattgtatttctatatactgacaatgtttttcaatgaacaactgtaaacaaaaaatctatttaaaatacttccaaaaatatgaaataagtataaatctaataaaatctacatatgacctatatgccaaaaactataaactgctgatgaaagaaatcaaagatctaaataaatggagagacatatcactttcatagaatcaacatagtaaagatatcaattctccctaaattggtccatagatttcatgcagttccagttccagcagattttcttgtacatatagacaagctaattctgaaatttatatagataggcaaaggaactacaatagctaaaacaattttgaaaaagaataaagttgagcccaggtatagtggctgacacctgtaatcccagcactttgggaggccaaggtgggaggagtgcttgaacctcagggtttgagactagcctgggcaatatggcaagaccctgtctctaccaaaaaaaaaaaaaaaaacaactagccaggcatgatggtgcacacctgcagctactcagaaggctgagatgggaggactgcttcagcctaggaggttggggctgcagtgagccgtgttcatgccacagcactccagcctgggtgacagagggagaccctattgaaagaaagagaaagaaagaaagaaagagaaagaaagaaagaaaggaaggaaggaaggaaagaaagagaaagaaagaaagagaaagaaaaaagaaagaaagaaagaaaagaaagaaagaaagaacaaaggtggaagaattacactatctggccaattgatttttgacagagatgcaagagcaattccatggagaaagagtatttttaacaaataatgctggaataaactggacattcatatgcaaaaagctgaacctcaccctaaacttcacactttattggataatgaatctaaatataaaatgaaaaagaatgaaacttttagaaggaaataacagaaaatctctgtgacctgggagtattaacagagttcttgttttaacaccaaagcacagtccataaaagaaaagtttatgaattggactttatcaaaattataacttttgttctgttaatgacactattaagaaaataaaagaaaatctacagaatgagaaaatatatggaaatcacatatccaacaaaggacttgtatccagaatatacaaagaactctgaaaactcaacncctaanccaaacaacccaattaaaacacaggcaacagatttcaagagacacttcaccaaagaggatctacggatggtaactgagcacataaaaagttgttcatcatcattagccactagggcaatgcaaattgaaaccacaatggcacactgctatacatttatgagactggctaagataaaaaaataccaatataccaagtgctgctaaagatgaagagtgactggaactctcacatattgctggtgggaatgcaaaatgacacagccattctggaaaacaatagtgaggcggtttcttaaacagtacatataccatgtgattgggtatgtttaaacaaaaatctggacacaaatgttcacagcagatgtattcataataacctcaaactgaaaaccacccaaacgtactttgatgggtgaagagatcctgtggtacattcgtacaacagaatatcattcagtgacaaaaaagaatgtaaggctgatgcgatgcactcaccaagttggatgaatctcaaaggcatcatcacgctgggtgaaagaagcctgtcacagaggagtctataccacgtgactccatttgcatgacattcttgaaaatgcaaaactagtgtggcggggtggtagccagggttgggggttgaggtttgggggaatgtataatatacacggtagctagcacaagggaatgttaaagggtgatggaattgtttgtatcccgactgtggtgattctacagatctacacttgtgttaaaattcctagcactgcattccccatccccttccagaaggtcatttttactgtatggtggttttataaaaaagaattttaaagttgggtgctaagggtcatccatgtacagtgttcatttctactgctatctggtattccactgtatgactgtactacagcctacttattgatggttatctggatcgctcttagagctttgtcttgagtatccctgcacatctcctcatacaaataagctgagttcctttagggctcataaggaagagaggaaattgctggctgtgtgcatcttttttcaccaaactgtttccaaatgtaacgcacattcccagcaggggcacgtcagaggtccagctgttcaacatcctcatcagcactgattaggagagtggggttcctgctgctctggcaggagtaacaaagcatcggatgatgcactgtggcctcactctgtgcctccttggtggctgatgaggctgaattcacaagctgcccttcctctcaccggagggtgtgctcaagctctctgcttggtttctcattgggttgcttgtgtttgtcttttattacaacttttccctactaattttttgttggttgtgttgcaaatatcttccccgcatttgtagcttctcatttgtccatcttctttacgataaagtgcttaagtttaatacagtcttattggtttttcactaaaggtttatttatggtttctggtttctgtgactggcttaagaatttattaggtcataagtatattcttccaagtatatactctaaaaataatatattttgcttttttttttttttttgagatggagtctcgctctgtcacccaggctagagtatagtggtgccatctcggctcactgcaacctccacctcccagactcaagcgattctcccgcctcagcctcccgagtagctgggattacaggcacctgccatcatgcctggctgaatttttatttttagtagagacagggtttcacccatgctggctaggctggtctcaaactcctggcctcccaaagtgctgggattacaggcgtgagccactacgcccagccaaggctatttttacctacgcataaaactgtctggtgaaatcatcaatgaaagaagagcacgaacttgaggttacctgcatgtttgagaagcaagtgtttaagaagacagcagagctacagccacctgtaagtgcctggaagtacacacaaactaacaactatcaaaggaggttgatcagacagcaagacagaatatcgtagccacctcaggcaccttaatcctggcatcctgtcattagtcagggtttatgattccattaaatataatttcacattccatatgccattaccatatagcatctccaagtttaaaaacacacacacaaattcctctctataatactacagcccttgatagcctttctggcctacaaaataaatctcataactaaatctttacagctgcacttatgatgtgagttgattaaaatctgacacagaatctctgatggtgaattttgaagtggagaggaaccccaggtggctggcccatgcggaagcacgcactcttacctctatggtgcctgcccatgcaaaagaagcacgcgctcccacctctatagtgctggtccatgccgaaacacacactcccacctctatactgccggtccgtgtggaagcgtgcactctcacctctatagtgccggtccatcggaagcacgcactcgcacctctatagtgccgggcctgtgctgctgcccctgccacagctcctgctcatctggcttctacattatacttcgggcaagtcttccctgatacatgcccagatctggttctcctgccacctttctccaagctttgttcaccatgatttgaagagttcaacacatccttaggccacatgagaccttcataaaatgccagctccctttctctgagcattgtgttaaaggacagtgtgggccagagcagtaagaggagcgcaggctcctagaaaatgtgaaactgaggctgggctctgagacaggcaggagctaataagggaagggctagattgaggtagaggaggtggtaagaagattggcatgtctggggagcagccaatgggcaggctggatgggtgaagcggtacgagattgtaacagaagatgagtatcaagcagatgttttgaatctgcctgtgtccacagctacccctggcatagcctcacctgtgctcgctgaagacagagttatccagaactatcttctccagcagttcaatcagttcattaggcaggtcggctgtcataaaggctttgacagtgaccgaaatctcttcaggatcccgtgtttctgacaatgctgtctgtaccacctggttttaaaaagcatttgaaagaacttgattaaagtcaattcaagactgtatctttgaagctaaacagaagggaaggactcctccaagatggtctggaatagacacagagaaaatgggagacttcttaatgtaacaaaggaagggttttcaaagttaatttcaggaaattctgtttgctctgttttgacaattagtttttctctcatatcaaatatgctacagactcttactcagctccaatgaccagtgcaccaggcattttgaaatgaatgtctccttttagatttgtctcttaaagccactaatagcaaatatggctccacttctctaatgaagacaccgcagggcttccagcagcctcttactagaagagagcactgccactgctgtggcacagtccacagccagagctgtggagccacgtgccttcacaccggatgacactcagaaccacaatctgaaggaaagaccaacaaaagactggctgtgccacccctcctccaattataggtgtctcacatacaaaaacacttacaaatagggtggaaagacagttttccaaagagtacatttcccatgcaacagcagtttggaacgccagcactgttctctttgcactttggaccaggcaccttcagtgacttccagaatctaatatttttgccaagtttctggttctcctcaggggtgggcaacagccgtgtatcaatgagagggaagagacagctctggacggtctttcatggctaacacagccctctgaccatgaactttcacctagcaatcttgaggggccttaaaggaacctagggtcaaggtcagtccagtccacctttctgctagtctttgtgaactcaatggtaccataagatgcaaaagttctacctctgtggaatttgtagtaactacaacaaggaggctgaagagtttgagaacaggagctctcccagcagctaaggaaccaaaagggtatgcctgagggaaaggggcaccaggacacagcacaagtccatccaaaggagaaggtacacttccaacagtgacatctaactgtcaattcttgaaaaccttggaggccggccgcggtggctcatgcctgtaatcccagcactttgggaggccaagacgggcagatcatgaggtcaggagatcgagaccatcctggctaacacggtgaaaccccagctctactaaaaatacaaaaaagtagccgggcgtggtggcgggcgcctgtagtcccagctactcgggaggctgaggcagaagaatggcgggaacccggaaggcggagcttgcagtgagccgagatcgcgccactgtactccagcctgagtgacaaagtaagactctgtctcaaaaaaaaaaaaaaaaaaaaaaaagagttcgagaccagcctggctaacatagtgaaaccccatctctactaaaaatacaaaaattagccaggcgtggcggcaggtgcctgtaatcccagctactcaggaggctgaggcaggagaatcacttgaacctgggaagtggaggttgcagtgagccgagatcacgccattgcactccagcctggtgaagagcaaaactctgtctcaaaaagagaaaaaaaaaaaaaaagaaagaaagaaaaccttggngcancttaaataaatacacacaggttgttttaagggcaaaaataaatttctnccatctgtttgagtcaatacaggatgccccacctaaggttgcctcaggacactgctctcagtaaacttttcataatgaggttccactccagacactaaaagcagcctccctctgttattatgcgctctggattacaggagcattgcagttgaatttcgcaccaggaggtggctacagatatccaattacagcagagataatgaaagaccagcagctctacccagaaacaggaagacaagaggcccccgctggctccggtatggtgcagtgttaaagtggcccttccccagtaccaacatgaagtcaccttcaaggtgtaccaggtggctggactatacctggagaaatgtctgatgtctgggaacctggatgtagaaccctagtagaatattgtgttgtttaatatttttattagatttggatgggtaagtccaaagttgaaacagagattcaaaacaacatgaccttccataaatctcaaagtatttcaaaataaaaagtttatttaaaaaagtagtggcacaggcttgaggaaacagtggacagaaaacgagaggatgaaattcagtagagataaaggtcaaatccagccctcaagcctttcgaaagcactggtccagcaggttggcaatgtgtatgagggaggtgggagttttaactggtcctattctcagggctgaagccacttgttggacgagggttttgttccaacattggtcttgccccacccctaaacagtctgcctagcacctagggacagtgctgagggcagcagaggcactatctgcaaatgtctgtgaggctataactggagaggaggctcttccacagggctgtgggaagccctcccagaggccgaggcagactcccacctgccaggccatacccaataatgacccctggccccagcactctgcccagtctccaaggaggtgctggatagtcacaggggcataaagagcacctcaacaaagggaagtcagctgagacaaccttgaaagctacttcacctctgtccacgagggctgagctgggcccagcatgcaggcatgacaccaggtactctcttcctgggctgcatatccctgctttggatccaagggccaactctatgcccttggccagttaacagttccaagtcagcttaccctggggaatcaagctatttttaggcaagctatttctgcaggggagaaggttcgtaaggactaagatgttttatttatttatttatttatttatttatttatttatttaatttttttgagacagagtctcacccagttgcccaggctggagtgcagtggcgtgcagtctcggctttctgcaacctccacctcctgggttcaagcgattctcctgcttcagcctcctgagtagctgggattacaagcatgcgccacacagtgtgttttcgtatttttagtagagatggggtttcactatgttggccaggctggacttgaactcctgacctcaagtcatccacccgcctcggcctcccaaagtgctaggattacaggcgtgagccaccatgcctggcctatttatttatttttttgagatggagtctctgtctgtcgcccaggctggagtgcagtggcacgatgtcggctcactgcaacctccaccccctgggttcaagcaattctcctgcctcagcctcccaagtagctgggattacaggcgtgtgccaccatgtgcggctaatttttgtatttttagtggagatggggtttcaccacgttggccaggctggtcttgaattcctgagacctcaagtgatccacccacctccgcctcccaaattgctggcattacaggcgtgagccactgccctcagccaagatgttttaaattaaaaatgaaaccagtcacttgagccacaatgatgatcggacggcaaaatgcaggtgtgcagacatacccatctctgtgcctcacctggtcaattagctgtctcctggatgggttggtctcctcaaggacgtgagcccagagctccggatcctttctgcataccaggtagcgggcctcgcttttgaacagagaattctcattgcacacctgaaatgagcacactcatgtgtgtgacacagcagccaaccagcggaagctgcttgggaggacacaccccaattcgttccctgtgtgcctgatactggtttggtggacagtcagggcccaggcaagacgctatgctttgacatgggatgagcagcatcctacagggttaacgatggactcaaactacctcaaaatgccctttccaagtttacaacaactcccagggatgtgccacatatctggccagtaggacttcctgcattcagggacatgctctgtctcccattctgtctgatacagccactagccatgggaggctactgagcccttgaaatgtggtgcgtgacaggaactaaactggtaatttttaatttagttaaatttaagtactcatatgtagctagctttaaaccatctgtaaaatgttatcagaacagcctagaactggtataaaacagcacaaacactgcaatgtttcaagatctaaaaactgtaaactgtgctttcactggtagatctggagacctttttctgaatgttataacagatctccaaaacaccaacagtccactggaatgttctagcgtgtgcagcacttgctaaatcctggtgaggatcagatctgttgagtgccagatgcccggcacaaggctgagcggcgtgcacacgtgcttgcggatgcagcgcagtccgcctgtgtatcacaggaaaagcccaagcaggctggtgtggcaccaacctcacaggtgccctattcatgtctggatttttagatctggatttttagatcaaatgattaggtaggaacagttcatacaattcaacctaaacatgtaattatatgtggatccaagcctgggcagatgcaggcaaaagacctgggcagatgtctcaaggagaggccagcaagagctcattggtcaggtgatggggaagggcttgtgtagagggttaccccaaaaagggggcatgaagtacaagggtactcgggacatgaggcacccagggaattgcaggcctctccaggtggggtggcaagatggatggctgatcaagttcgggagttgggaaaggtggcagtccacagaggagctcacgagtcaggccaaggagttcaattctgccctcaaattgccaggcaatagtaaggactgtaagcagagggatgataagtcaggttcaggaccaactggtctacaggtacaatgcatacaaattgcatgagcaagttcccaaaagctgtgagaatcacaaggaaataatctcatgacctgccatctccaggtgcacagaaagccctgatcagctccccacaggcacacctttgaaagcttccctgggagcccagggttacatgggcagctcagcacatctgctacccaccttgatgagctcaaggtcacactgcccccgctcataggcaacacaggccagatgggggtctcgcttctcacagtagcggcccaccacgctgctgtcatagtaggcattctctctcaggaagcactcggggctgttgttgctgtcgatgtagattttagccagtgcattgtgagtggcaggctcctcacagccttcctgaatctgggactccagccagggaagcagcagcttgagcctttgaaagaaggaaggtgctgtaaagtctcaaggctaccactggaagtcttgagggcaactccagggctctgacagatgtttcctgaaacaaaaaatctcagagtccattgacttcaggttgctctagggaccaagatggacctggtttccaaactgatttctactgttaggttttcccccaaggtcttcacagtaccaatagcaagtaactcattgctacatctaagatgtgtacatgaacgaccagctatagagacagtcctggagaattagacagaaacaacaacagacactagaatccaggggtaagagaaaacaccaagtaaggacaccttacctatttcttttttctacttcagccaccaactcatcagtagagaactgtcctctcactgccatgattaagtgtttaatcacttcctcagaacaatccacatcaagcagccctccaatcacagctggggtccggctagggttgacctagggtagtcaaggtcaagtaacttcagtgttgcaaacacaagttattgttagaagcctcctacgacgtggacagtttgggcaaaaccctgaaagggctcctgtttagcactgcgctgtgtcccaccaaaattcacctgctgatgtcctaacccctagtgggattctacttggaaagagggtgtttaagaaggtaatcaatgtcaagggtggggccctaatgtaatgggactagtgtccttctaagaagaggaagagacaccaggagtgcacatgcacagaggaaaggccctgtgagggcacagccaggaggctgtctgcaagcgtgggagacagccttcaccagaaaccagccctgccgacaccctgatcatggacttccagcttccaaaactgtgagaaataaatgtgtgttgtttcagctgcctggactgtggtcttctactctggcagtctgagcacacgaacccaccacccttcaaaatgatagtctctgaaatgtcaggtgttacaggcagcctctgaggggaagactgccactgactggggcccagaggcagccgggtgtcactccagggagccagcagtaccttctgcacgtagatctcaatgtacctctgcaggttgttgcggtataaatataggacaaggtcatggacaaagccaaaacgatcacacacgatgatgaggggaagctggtctgtgagcttggcctcctgaggattagaatgcacagaacaagtcagggagtggagaaaccagacagccagacctcggactcattgcacacatgggacggctctgtctctgcagcagagtgacacacaggagactcagaatgagactgctctaaataggctgtcgttttgtggtatggcatttgctttgggaaataagtgagagaaagatattagtatttggttaaagactgctacatttggcattaacattccaaatctggacaaaaatatcttttaagacaagcagctcattatgtgcaaacccaacagaaaccaggccattctcaagaacagcacacctgcggtaagggctgccttttcagacacgcagccgcaggccatggaaacacacccggccaccattcccagatgatgatggcacttgggtaggacagccacaggccaccacaatcatgcctcccctcatgtggtcccgtgcctagatcacattttgaagttttaagtgtggccacatgacctcatttcctccaatggaacgtgaatccaagtgtcatctgccacttgcaggcctcgcccataaaaaccacctatgctggttcctctgtgctcttcccttcctctagctgactgggaagacgacatccaggtgaggtgctgaacacggcaaagcagccatgaagctggtccttgaagtacagtgggaaggaaagtcaccccactgacctccagcctaccctggactgccacataaggaagtaggcttcctgttctttatgacactagtgctgagtggtctacttgtttctgcagctttgcctgcctaattgacaatggcactaatgggatgttgatgaattacaatgcagcaataagtgccagatacttagagcacagcctcaagctgctttccacactcttaaaacgatagaagggttactttagaactttaagccataaagtggagctctgtccctgggactaaggggtccctggcgagacagatccagcttcctgcccctgggacgtcctgcggatggtctgccccacctgccatcagcaagggcagctcatggaaggaggcagcactggaacacaccttcaggaagttcttcacacgctctgggttgtagcagctgctctctcggcatatcctctccacctccttgatctgccctgtcttacaggcagcctgaatgtatttcagatgcacatctgggtcttggctgaagttcacgattgagcccaggaagtagaagaggcctatgaagagagaccattccatttttgtccttgtaacacctgcctgtctcctccgtagctgctgcccaccttccctcgatgaccctgctccactctccagggacccacagcacactcagaactcataatcaatatgccatttgtctgttttggcagctcccaaaaatagctagtcggatttccattatatttggcaggtatacctggcatgttttgatgtaaaatactagatatttggtacaagtgaaattccttttgtgggcccaggtatacctagatagtcgtcatcaagagtaattcccactgaggtaatctgaaatggtggtgggactgcttctctaaaaagacacatcaagggacagagaaataagccatggcctccaggaggaggcctgcaactcaacacagagctgacagtgacatgggcaccacatgctgagccccagggtgagccccagaggacagcattcacagaggctaatgatgttcctcatcattacagaggccagccaggaggcaccagtaacaacagggtacgacacatctgagaaggcccctccctgtcgaggtctttcactgtaactgtgagaccctgatgctaggaagggaatgggcagcccctgggctgacggttctccaccaacctactctactgccctctcccagcccagctccactcaatcgtctgccatggtctttcctacaggggtgtcttctaaagagaaggccagttccctgaggacagggtcatgtcccaccctccaccgatgccccaacctcactggacacatggcagtggcttgatgcctagacaaatgcttagtctctatcctgggtgggccagacagcccccatctgtccctaacaaagccactcccatcccaactgccctagaacacttttttggtgtgatgtccaagaaggggaaaggaagacaaccaggttaccttgtcagccccccacaatcaactgggtagcagacaccacaaagcaatgcaccctctatcgtgggctctcatttaggagaggcccaaagagcctccctcctggggctgtaaagaccagacatcaggccctttcactgtacccacgacacaggcttttagatgaattcttgccagactgtgctgcgtagacacaccgggctccataagtttctccatcccatcaccaaccaacctgatttcttcctttggaaataccaaaaaggttactgaagctgagggtgcacatgagatggcagtagcattctgccaccgactgagcacccaaggcagccagtgctgcatcctgcctggctttgcaggaaggccgtcttaaggcgggcaggtaggcagcaacacctgagaaaggaggtgtagtcacatggtggggtcggcgagaggctgcatggtttacctttgtaactcttgaaggattcaaagagctccaccagggcctgcgtgcccagctgctcgtggtacttagaggccacctgcacacacagctgaaggttctgtctgatgttagcagacagcatggcatgcagacactccacagaatcctccaccgataaggagccaaagaaattgacaagccactgggaacaaggaagagtctgtccacaacgatgcaccactctaaagattgctaacacttggaaaataactaggtcattctcctgttcccctgagtgtcaaaaatacagagaatttccacataaaggggttgaaaagcaactatccatcacgggaaaaagtaggagcaaggagtaaagctgggaaaagacactgatctaaactgttcacctggaatattccacagatgatgctaaaacttattccataaattggaacacaatagctagtttagctttgctaatggtttcagacagtcctattaggttgtcaatgttaaaaggtgaccagtatactcctgctattagactaagtcaaaggtggatatcagaaagaaaggtgctacagggcccagacatgctgctgagcagataaactttgtgcgtgggctgaattagaactgcttttggtagtaaagtatggtaggttagggcagtgacaggctcaggccacagttccacaatcaccaacaggtgaacactggggagcatgtgacattaattgcatagacaacagccataataggagtgcccaggggtacacagtacctcgggattgaggaggtgagtgtggaccacagccctcttgatgtcatagaggtcggtgtagtgctccagtgcttgctgcaggaggcctgccttctcacagagctgggcaatgtgggcccggtcgtaatgagtaaacattttatttccaaggatggcatctgcaacctatgaaacagggagttcggtgagaagccctgatcaatggcaataactttttaagaccagctgctcaatcttgccccagggtagggtatagcctggcaaccagaactcacaggcccctgtccacatccatacctctgtggtggcagcagtgcttgtgggtcccaaatccctggctgtccttcaagccatcttaggccctttgcacaaggcttcattctcccatgttgcagctgggccaagcccatgtggtcacagagttgggcctgtgagaaaggctgaggctccataaagccctattactgggatgagtccaagtcactgttgcagcttttaagcaatcacattctttttttcctttttttttctttttttgagacagagtctcactccatcactcaggctggaatgcagtggcacaatctcagctcactgcaacctccatctcccaggttcaagcgattctcatgtctcagcctcccaagtagctgggattacagacgcacaccaacatgcctggcttatttttgtatttttagtagagacagagtttcgtcatgttggccaggctggtctcgaactcctgacctcaaatgatctgcccaccttggcctcctaaagtgctgagattatagccgtgagccaccgtgcccagccagcaatcacattcttatagggtttctatggcaagatcaatgtgagggctcaagtctaccgattctccttgaatgagctcaagccttagattagcaatgaccagaaggagacctgaacaaaacaaatcccatttgtgcttactagacttctctactaggctaaatacagaactaggagttggggattgcatttaaaaaacaatgaacactcctggaaacaattttgatgaggcataaaatcttttttttttttttttttttgagacagggtctcactctgttgcccaggcgaatggagtgcagtggtgcaatctcggctcactgctgctttgacctcccaggctcaagcaatcctcccacttcagcctcccaagcagctgggattacaggcacatgccaccacacctggctacttttttttttttttttttttgagatggagtctcgctctgttgccaggctgcaatgcagtggcatgaccccaccctgctcactgcaacctccgtctcacgggttcaagtgattctcctgcctcagcctcccaagtagctgggactacaggcatgcgccaccacacccagctaatttttgtatttttagtaaagacagggtttcaccatgttggccaggctggtctcgatctcttgaccatgtgatccacccgccttggcctcccaaagtgctgggattacaggtgtgagccaccgcacctggcccacctggctaatttttatatttttttgtagagatggggtttggccgtgttgtccatgctggtctcaaactcctgggctctgctcaccttggcctccaaaaatgctggggttataggcgcgagccactgcacccagccactaaatattctcttgaagtaagtaatttttgggctaagactggataggtcaacacagcagccttgcagcatggctgagtgagtgctccctcagtatctaatgatggtcttgacaagctacactcctgggtgccttcccctgccacctggcacactctttcttattccttctaggatctgcatcaccaaccaggtatggccacagagtgaccacagccactgtcacacaccagaccacttcagagtgatgcacagagttgacgatcaaacacagtactaagagtagggctttagaacatctagcacttacctgagtctcctatcctttgtttccttcaggtttatctttacttcttgttttcaaacattttctcctcatagcaacagtgtattttatagaatgtagaaaccatcacgcagtcctactgcccagagaagactgccagcgtcctggggcactaagccagagcctgctggcacctcacccaactacttgtttctcctttagggtctgggcattccttagggtctgtctgccaagtttctgagtgacgcttggtgtgtttcaaatctcattcaccagaaacggttacatacactcacaaagtcatgagagtccagtagaccccaagcagcaaattaacagtacttttatttcctagagttggaatatgacccacttcttagcagctaacttgtagatttgaataaattgaggtaacagaacaatatacttaatatgttgtttcctaattataaaaacagtaagtgattattaaagaaaaatcagaagagataagtaaagaacaaagtgaacttgtacaatcttatccacttagtaccgtggtgaacagcttgatataaactcctctaaatccctttcttgtatatatatctaaatttaacccaaaatagcacagacatgtgatttgattatacctgctcccacaagtttcaggccaacaaatgatgcctcaccacagtgagataccactgcacgcccattaagatggtgattactattattattattttagacagggaagatgtgttggcaaggatatacagaaattggaacagctgagcattgctgggaagaatataaaatggtacagcctcctggaatacagtatggtggttcctcaaaaaggtaaacatagaattactgtaggacatgatccagcaagtccacttctggatatatgcccaaaagaattaaagcagggtctcaaataaatctttgtacacccatgttaacagcagcattattcacaatagcctaaaggtagaagcaacccaaatgttcatcaatggatgaatggataaacacatgtcatatatacacatggtggactattactcagtttcaaaaatgaaggtgtttctaacacatgctacaacatggatgaaccttgaaaataatatgctaagtgaaaaaagccaggtaaaaggacaaatattttgtggttccatgtatatgaaatatcttgaaaagccaaattaatagagacagattagaatggcagttgtcaggggctgggaaatgaggagtcactgcttaacagttacatagttactctgggataataaaagttctggaactatgtagtggtaatggctgcatagcattgtgaatgttcttaatgccactgtatcagacacttaaaagttgttaaaatggtaaatttggttatgtatattttaccacaatgaaaaaaagaagaaaggaagaaatgctgccctaattagaactgtttccatgaaagtcctgtatcatgatttctggaaaatccttttaaggaaagtcatggagaatgtccactgagaagtacaagataaacatctggcacaagcccagcccagtccaaagccactgtgctcaagtctgcaaacccagagaggtgccacaggtgctctgcctctcggtgttagcctacaagtcactgacctggggtgcatgaacaaggttcatctccaacagccatgtctgcaggagtccctcagctgggcgattattcttcaaggcatccaataagaaggaagtacactgctgaattaaactgttttccatgaaaatgtccacaatctgaaacatatccaagccacattttcactcagtatgttttcattcagtgtttcattttcctattgaaatagttcctgaaatattatctcatttagaaattcagcaattagttccctcccttggttttttttttttttttgagatggagtctcgctctgtcacccaggctagactgcaaaggcacaatctcagctcactccaatctctgccctccacctcctgggttcaagcgattctcctgcctcagcttcccaagtggctgagactacaggcacccgtcaccacacccagctaatttttctatttttagtagagacacggtttcaccatgttggtcaggctggtctcgaactcccgacttcaggtgatccgcccgcctcggcctcccaaagtgctgagactacaggcataagccactgcgcccggcccctttccattttcttctgtcatcgcaattcacatacagccaggtgtggtggcatgtgcctatagtcccagctactcaggaggctgaggtggatgcattccttgagcccaggagttgagaccactgtgggtaatgcagtgacctcatctcaacaacaacaacacaattcacgtaatttatggtcattaatttattaataatcttgcaaaatcatatcacctacatcatacttatcagtgaggtattttactgaagtatatgaaagggagtaacttttataacatatgaacccccaagcagtaatcatacattacttaatcacatcctagaggcagctgtgatgcttaactttaggtgtcagcttgactggattaaggaacacatagagaacaggtaaagcattccttctgggtgtgtttgtgagggcattcccagaggagactggcatgtgagttgggggaacaagtagaatgatccactctcaatgtcggggaacaccatctaatcggctgggggcacaaaaaaggaaagaatagatttcttctctctttctcctggagctgggacattctccacctcctacctttggacatcagaactccaggctccccagcctttggactccaggacttacaccaaaggccccccagggttctcaggccattggcctcagactgagagttacgccttcagcttccctggttctgaggctttcaaacttagattgagccacgctaccagaatccaaggtctcctctagcttgcagacagtctatcacaggacttctcagcctccataatcacgagccaattctcctaataaactccctctcatatatctgagatagggtctcactctattgcctaggctgaagcagtgacaaggtcaccactcactgcagcctcaaccttcagggctcaagcgatcctcccatctcagcctcctgagtagctgggaccacaggtgtgcaccaccatgcctggctaacttttaaaaaattgtttgtagagatgggggtctcactatgttgcccaggctccctttcatatagctatagctacgctattgattctgtctctctgcagcatcttgactaacaaagcagctgatacttgatatctaactcatatatatcattatattattggggcacaactgggaaaatgcaaatatttacttagacaattattaaagttaaattgatgttaatttaaataattaatatgccttagtaagatgtgaaatacaggaataaatttaataattgtttttgaaggacagctttacaggaaaataaaaaagaacttattaactgtggaacttctcataaagtatgagaagtttatattttgaacaactttaaaatatgaactgtaaacaagatgtgaactggaaatttctttcctattgaaagctaagtaaatttgtctcaaatctcttattcatgttctccaaaatatctgcagattcccagatgtacaaacacatacaactgcacttattatttctaaacagttgttggttctgatgccttgcttcaagctttgttacacatctatatatcatcaaagctccttgtaccaatttactgaaagtgacttgtcatgtgtttacatctaaattttaagtaggttacactaaaaaacaggctgatgctcacgtaatccaggtcagtcagacacccacaggatgaacatctgggggacgcaacagcactagctcctggtgctcaggccaatggtcagggagagacaatgatgtagtaactggggtgggccacgggatggagggctggaacctaaatgacatcctcacaccctacaccatcaccacccaaagacacaaacccaaacaaacattctctaaagtacttcaaaacaaaggaagcaatgagtactcacatagtaaagactagaagacaaactccccaagtacactagattttttaaaactgcaagattaatagcagatgaagaaaagcattgagacaagttaacaggaaacgaatcaaagaaatcttctagatggctctaaaaagccacaaaaagttgtccaaaactgcctacgctcacctggctaatgttggccagcggctcctcgtcctgcactagcattcgagaaaactgcaggccctgttccggactgatcttcattacacccctcagcagaaagatccagtctggggtgtacccaacctagaagcaagggagcaccaatcaggaaaatcaatgaaaaaccctgggcattagaaaaggaagttatccatcctttgttttaaactcgtgttaacaaagaaatgagcagcaacattatcatgtgtaggtaccaccttctgccaaacacaatatccaattaaatgaattgatttaatgtacatggaaggcacaattaactatacaaagagcccagaccacaaagaagtttcctgatctgtgtgcaaacacagcctgccagtaagcacacagggataagatctgggagtctgccaaaatatcaaattaacatacagaaggaagagagggagagaaaaaacaagataaagctcccaaataaaacgaagatggaaggactggaaaactaaggataataaaaagctgaagagaataaaatatgatcattatgaataaagatcctaacagcaacattgccaactctcacaccagaggacttacaaagaagggtattttataaactttaaaatcagcaaccactcaaccacacgtgagtaatctgtgagatgccagtggttcaacacacgttacctttttggcatagagcacaattttctggaattggcctgtttctgcaaaacactggatcactttgcttggcacatttgcccgaaggtacacactcagagcgagcatggggtcagtggttttgaccaagtctccgagctcctctgagcactccagctgtggtatgccaagggacaaggcaaagttaggaggcaggtagggagcctggaccaagttttcaagctgtgcgggggggctacgagctcacaagtgtttctaccttatcttctttcagccacttctctaggagttgcttacgcccctgctgaagaaccagatggcaaagttctaaggattcaagtttattgagctgaccctggtcgagcaggattccgaagtactgcagcaatggagaagcctggccagactgagcgggtatactctggaatttctggaccgtctctctggtacgcaggattccctaataataaatggaaaaataggtcattgtgttgtaatcacaggggatcccttcactcaacttccttgtatgtaaaaacaaaaatctgccagtggaaattccacactgctctgtcatagacaaaaagtcctctaccaaggcaactgcttctatcttcaacaataaccataagtataggggaatctaggtcctccaggtggcttcacacttagggtcttacttctcccccagcatgctgcagtaagaattcggcctctcaatcagtcttgtagtagtgaagttctgctatcattatattctaattcaaaatactcaaattcacagatgaaggctagaaatggtttgttcacaactaccccttgaaagacaagaaaaattctttcaaggacaagcaacttgaaagtctttatctactcaggaacagatccagtctctgaacaatttatccaaatgaaataaacccaagaaaaagccatatgccgaaatgctatattctaaaagagtggagaaagtccagggtaggactatcgctagataaaacagggaacaaccacttgatgtattgtacagttgcatatttgacaaccaggtagcaagagtggaaaatgctaagttacagaaatgtgaaactgtatctaagctgttgggtgagaggtacgtatgcacacaaagtgggaggcgtgaagaagtgccgatgcagcaagagtgtgttttttgtttacttcctttactgttatgccattggtgcaaaaattttaaactaaaaactcctaacataacactaatagactgcaatatcactagtgaaatgcttttatgacttattttcctctcaaggttggttcttaacactcagaacacttgaacagtattcaaggtttatcacctttggtgcagacgctgcaactttggcggcttcagcatagctgccctgtgcaaagagggtattgaattttctcacaaacaacttctctgccccagccaggttactacgaacggccaaacgcagaccaaggtctggattctgaagcacgttggttgcataattcacaatgttatcttcctcaacacaaactgacagtacctgtaaggacacaacaagtgagagcagcccggcctagaagagtgctccaccatccctctgccatgttcccttccgatgctggagtggtagccacattctcaggcgagtgttgagcacacctgtgatggtggccctcacagtgaaaggaggcaaagcagccgaaagccaaatggtaacaaaacagaacagcataggagtctatgtagttattaaagtcacacagataagtgtgatgcgttctgcgctacagcaaaatgacctatgtggatggaactgacaatttttcttcttaaactttttatttttaaagtacagagtttctttcttttttaaaaaatatttttgtagagacagggtcttactatgtcgctcaggctggattcaaactcctagcctcaagcaatcctcctgtctcagccttccaaagtgctgggattataggaatcagccactgttcccgacttttttttttttttcccctgagacaggctctcactgtttcacccaggctggagtgcaatggtgtgatcacagctcactgcagcctcaaactcctgggctcaagccatcctcctgcctcaacctcccatgcagttgggattacaggcataaactattgtgcccagccaagagtttcttcttttaactatctttttcaactatggttgagaaaagttacttaaataccatagtatctgctttttcaaccctccccagttagggtgtgcatggtataaagatgatgtgcatcagaactgctgttctatacgcaggaaggagctgctctcctcctggaatcaatcctgtgttaggaatggtgctgtctgaagagaggaagtgtcaatatgaaggaggagacatgggtttaagtttaataacaggaactattaatagctacacccagctgctttcctagagaagggggaaagtttaaacgccagtccctaatgaatggaaaaggtagaaaatgaaatgtcagagttacacacctgtccctttttgttgacaccaataattccagaggttggtttgtgtggagcagtgacaaatattgtgtcagcactaatacggttcatgcagatgcacacgccagactctaggtcgtacagatgaagatagccatactttgtgatcaagtaaataacaccatgtttagctccaatctataagaagacagagagcaagaggttggaaagtaaggaggagaagccatgcgggtaaaaagagctcacaaatgataaagaggattcttgtttgtttgtttgttttttgagatagggtcgtgctctgtcacccaggctggagtgtagtggtgccaccatagctcactgcaacttccgacctctgggctcaggtgatcctcccatctcagcctccaatgtagctgggactacaagtgtgagctgccacacctagctatacaaggattcttcagtttctcaggccgagagattactggtgggagcaatgctttcctgagacatggattctaagttgtacttgattgagaattagttttaaagacaatattttgtccaaccactctcaaataaaggtccaataaactcaggctactccatttatctttcaggtagagcgatcctttcacagtttatcgaacccctttaagcaagctgtgagttcataagagaaggggaaagttctggacaaagacctcaaacgccaagatgatgttccagcatgccttctaccaccacttattaacctttgagttttgccaaatgctattaacttttacagaaaaatatttaacacacaagaaaacctgaaggggctggggagaaaaaacagatgcatttgcccaaccagattattaaacatatatattaaaacagacagtaatttttgaagtatgattttaccactggaagagacagagagagaaaataattaagagccctgaaagagaatgaatcatatatgagaatttattaagaatgagtgtgtggtggctaatgactatagtcccagctacttgggaagccaaggcaggaggatcacttgagcccaggagtttgagtcaaacctgggcaacgtagcaagactccaactctagaaaaataaataattagtaggtaacatattagtggaaaataggcactttaatcaatatataacatatattattaatatagttagctagctatctggagatggaggtaagagtaaagaactgaatttctatcttactctttagatcaaagtaaattccagatgggtcaaagattttaaataaaaaacaaggacaattaggataggaatgaaagaaaatataggtaaatgttgtgatcatcttcaggtgcagaattagtctcaaaacatgataccactgccacacaaaaatgcagcacttccataaggtgccacatatcacaaattacgactgggaaaaatattcaaaatacatcagacacttagtactctacaagtacaaaaagctcttacgaataaggtaaaaatcctggagttgggcacagtgacacacacctgtaaccccagctgcttgggaggctgaggcaggaagatcgctcgaggccaggagttcaagactggcctaggcaacatagcaagaccccatctctactttttaaaaaaagatcccaatagaaaaaaaatgcaaagattaggaaaaggcaattaaccggatacatatgagtggctgatacatcaattctgccttgatggtaaccaagggaaagacatcacaacatgggatgctgtccagctaccaccggcagcatcagtaggaatgtgaactggccagcatggtcaggagagtctgtgatgagagtgtgcccctgacccagcagtttaatttctaggaatttatcctcggacttttagactaacatacaaagatgtatggagcacaatgttccttatagtgtttcttgtaaatgtaaataccaatcaacaggggattgtttaaatgagttgtagcaaatccacagaacagatgacacagacaataaaatacatacattatgttactggaacagaatgatctacaacatagctagaggagtttatacagcagcaaggctagtgcagagccattttcataagagtccatctgtataaatctgcacaaatgtatgcatgttaagttacttccaaaggggtagccaaattatcagcagtgctaggatttcaggtgatatttaatcctgctgttacatttattgatattattagaaatgtacagataacatatattttatgagaacaaaagagtaaaaaggagagtagattatataatcttacatatataatgtgatgccaattttgttcagaaaaggtatagatctaaattttttataaaacaaattgtaagattttttatttttattcttatttatttatttatttattttttggaaatgaagtcttgctccaggccgcggtgcagtggcatgcagtggtgtgatcttgcctcactgcactctctgcctcctgggttctagaaattctcctgcctcagcatcccatgtagctgggactacaggtgcacaccgccatgcccagttaattttttatattttagtagagacggggtttcaccatgttgcccaggctggcgtcgaactcctgagctcaggcaatctgcccgcctcggcctcccaaagtgctaagatgacaggtgtgagccaacgcgcccggccaagatttcttatatattttacatccaactggtttatctacagaggaatgttttctgactctgtgcctttgacacttccacaacaatattctgctcctcaataaggaaagcacacttgatcctgtcacgaacacacttagcacacacggaaccaccacaggccctgctgacatgtgtttctgttttagggaacctcacaagaacttcaggtctcatagcacgaactcctcgaagtctggctaggcacatgccacatgcaggttcaggtgttttcccaaccttcttgatgtaaaggtgaataattctcccaccaggggcttgggactacctagtttcactagaggctgcgtgtcaaaggctgggccattctgaatgccagctcaaaggactgtccctgggagctctaggctccctcaatggcagccaattgtaaaggaaataagtgttttattcttttttttattattataagttctgggttacatgtgcagaacgtgcagttttgttacacaggtatacacgtgccctggtggtttgttgcacccattaacccgtcacctacattaggtattttattctttaaatattctcataccacagtgaacatctaatcttttataataagaaggaaagagctgaggactttgatgtgtgacttggcaacgtcttcctgctgccctaactcaccctcatgccgggcattcctttctacgaacagggctttcccagctcacacgccaaagccttaggcctctaaatgggtttgaaagcatcacagtggcaggagacagcagaagcagactaaaaatggcagcctcctgtatcttgggaggtgctagagtagattttaggacatgaagatgtttagagagcagcacattcgtacctgcatagccactggaaaatcattctgtgcctctggaggaaaaaacacatctactgctttctttacaaaaggttggtttcccgctgcaggctgtccaacttcaatgatgtgcaactagaagagagattttaggtcaatcaaggggaccgcctgtggtggtgggcaagtgctagtcaaggcacagaggcaagtggagcctcagctccacacactggatgattaacgctaaaagtcacattcaaccaaagcagaacaacccccttgtcggagtgcctgtgattatccaataacctgctgcccaccaccaagcatggcacaaagggccaatgccaggcagcctggagcctcagttccagcacagtggcagagtcacttcccctccccgggcctggatgccgatgaaacaaagggctccagtcagaatctgctgtcccttccaactctgctctctgcctttctgggtatggcccagactcatacaagcctgttagtgcaagatctcatcactggaggcgaaactcacgagacatcctcaccatggcacaggcctgaggttttcaaggttgtgctgggcgggggtaagaatctgatgagggagcccatccctgccttatgagaacagctccaagttcctgacctatgccagtgccttccctataactttctttttcttcttttttttttttttttttaagatggagtctcgctctgtcgctcaggctggagtgcagtggcgcgatctcagctcattgaaacctctgcctcccgggttcaagcgattctcgtgcctcagcctcccaagtagctgagattacagattacagatgcatgccaccacacccggctaaactttgtatttttagtagagatggggtttcgctatgttggccaggctggtctcaaactcccgaccccacctcgggtaatccaaccccacctcggcctcccaaaatgctgggattacaggcacgagccaccacgcccagccaccataactttcatctaaagaaaaaatattataactaacacaagtccacaacaaaatccaaaatgaagggtaagagacacaaaacaagggcgggaggctgggcttagaggacacagacaagggtgtctgtggaggggcagtctgggtttgcggtctgggtttggccgggcagagagaggagggaaacaccaaaggggctcagataaggaggggagcagcactgagagccgggccaatgggggaggctgagcggcaagcatgtgggtgctcctgtggggacagaagtctgtggatggggaatagaaaagtcttgcactgggagctttaaggcagataaaaggtagtttaggaaaattatctggctaggcctattggtaagaaggcgtgaagcaggtctgaggacctaataaatggctattctgtaacccaaatgtgaggtgagaaaggcttagtgtaccacaaaagggtaagtcagatgtgggacttgttaaaggtcagacagtgacgagagaatagaatggggcttgactgctatgggttcttgctcgggagctgagaagggtgacactgccagcaggagcagaggcacagaaaggacaccaggctctcagggcagcagcaggaggaggttggcagaaaagaactgtgtccaggcaagctccgccccacatgtggagacagctggccagtcccaaaaggacaggtgagtcctgaaaggaaggtgcatgcctgggcacaggcggggcgggcaccctcccaggaccccacacccaccctgcagccgggaggaccgagtctgccacaagacacagggccgctccaggacaggtactgtcaggaaaccgcatttcccaggctctctgggtcacagaagacctcctggtccatctccagctcggctggaggggcatgcccaccagaaagctaggtgtagagagaacccccagccccttctcttcttggggctgccgtctgtgtacagagccccgctctgggaagtgctcttctccacagggcactctgtgaggcaggctctgctcctcagagggaggcctgtcgctgccctgctgcatctgtaaaggagaggtgtgcctcactctgagggaatatgggagcaagctctttgagccacataactaaagtcagtgtccttcatcagcaacaaggctgacacgtgacccgagtccttttccttctggctctcaaatgaggagggcatgaagtatgttactcaacaggaggccaaagtattcagtgtatttcagatgaggaagtttgtaaagccacattctaattgagaactcctctgccttggggaatatttcggggctaacgaacaacccaaaattatggtttgagaaagtgtttttcacaagacgactgtcttgaagcagctctccaagtggctgagaccacaatggcggaacccaaggtctccctgacatcacaagctcttctgtctcctcacctctgcccatggcagccctgccgagcagccgctggccatgtccctgagcctaataaaacccactggctcctgggcacagtctcaatctctctggagcctccctgaggcgcctcccaaccacctgggaagaaccatgctaatggcaaggatggcaccacactggtgatttcacagtcatctccccaagagcagaaactgtgcctcatctaccttttttttttttttttttggagatggagtctcgctctgtcgcccaggctggagtgcagtggcgcgatctcggctcactgcaacctctgcctcctaggttcaagcaattctcctgcctcagcctcctgagtagctgggactacaagcgcacacagccaggcccggctaattttttatattttaatagagatggggtttcgctgtattgtccaggctggtgtagaactcctgagctcaggcaatccacccacctcggcctcccaaactgctaggattacaggtgtgagctaccgcacctggctgcctcacttacctttagagtgcatttcagtctagtctgtgtggaaggattttttttttttcttttgagacggagtctcactgtgtagcccaagcaggagtgtagtggtgcgatctcgactcactgcaacctctgccttgcaggtcccagttcaagcaattctcctacctcagcctcccaagtagctgggtttataagaatgcgccaccatgcccagttaatgtttgtatttttagtagagacggggtttcaccacgttggccaggctgttcttgaactcctgacctcgtgatccaccctcttcggcctcccaaagtgttggattacaggcgtgagccaccgcgcccagcctgaggattttttaggggaatggggccacttaatcatgtgcatcacggtgcacagttctcaacaccaccatgaacctttcctcacacagacatctgcaggccatgcccagccacacacacgcacacccctaacaccagctcatgacacttttctcagggagaagacagtagagtggatcttaccttgcctcctgtgggattacgtacagcaaagcagaaaagggtggcaggcttggcattcccctccatcttgaactctgcaaaagccgcagcatggccttctatgggttgtgaaaccttcctatccacagagtagagctgcattgctccaaccacacggttttgctaagaaaagatattatgcaatgaaagggagagaaaagagaggaatataaagaaacaattcttaaaatatatttctaaaatgaaagtctcatacattagaggtatacttcctctagtaaaaattaaatgtattagctattaaaggcatgatatcactctgaattttatgtggaaagatggcaaacactatggaaaaaaataagaccacaaaaaagtaagatggacaaacctaatttgttaaatatagtaagtgtgagagcattttttcatggaaagtaactcgtgcactttggaggaaaaactctaaagcattaatagtagttaaatcgggggatgcaatcacaggtaattttgaaaattgtgttttctgaaatttctaagtagcaaaaattgtatttaataaaaaccaataaggccagcacagtggctcacacctgcaatcctagcaccttgggagaatcacttgaggccgagagttcaagactagtctgggcaacatagcaagacgccatctctacaaaaaaataagaaaattagctggtcatggtggcatgcgcctgttgtcttagctactcgggaggccaaggcagggggattgcttgggccaagaagtttgaggttgcagtgagctatgactgcagcactgcactgcagcctgggtggcagagcaagactctgtctccaaaaaaaccaaaacccccaaaccagtaagactaatatcttttataaaacttagaacttgtattttctttctttctttcttttttttttttttttttgtgatggagtcttgctctgtcacccaggctggagtgcagtggcgtgatctcggctcactgcaagcttcgcctcctgggttcacgccattctcctgcctcagcctcctgagtagctgggactataggcgcccgccaccatgcctggctaattttttgtatttttagtagagacggggtttcaccatgttggccaggatggtctcgatatcctgacgtcgtgatctgcctgcctcagcctcccaaaatgctgggattacaggcttgagccaccatgcccagccagaacttatattttctactaaagaatttcagtacatttatatccaatgtcaaatgctcaaaaagctaagtgaatggaatacaaaagggtcccagttcaagctcctgtaattaaacattcaatcctctctgctgagtgagctcacatatagtcgtgggtaaaatcctcagtctattcctcactcactcacaactccttaaaatgggataacaaaggcttcaactttgtctttaaaaatattttctattgcacagatttctgttaacgttattaagcaaagtactgacacatgctaccacatggatgaaccttgaaaacatgctaaggaaagaagccaggcatgaaaggctgcatattgtctgattccacctatgaaatatccagaaaaggaaaatttattgagacagaaaatagattagtggttgccaaaggctggtaatagggagaaataaggagtaaaccagcagataagtggtctgtgttttaacagaaaaatgagcatggaaaggtaaaaatgagaatccaaagacaggacaaaactcaccctccccaagagactgtgggaagacttccagcaacatgatgatagcacatttgagtcctaaaggtacagatacctaaacgaagcctaaactgcagccaagacgaagaggcagagaagacagaacagccaaggtgaaggtgagagaccagaccttaggctacgtgtgtggccttgggccgatgtcctgcttctaagtcttaggcacctgccaggcttaccttcccacctcatggggctgctgagtgttaagtgtgtcaaattttggtaaaggcatgttaaggactgtagcaggcaaggattcaatgagcaaatgcattcattgtgccaggcaccatgctaggggccagggataagtaaaatatgacacaggtccttctctcaagaacagatggtaagagtttccggcaagtacacaagcaactgcaatacagagtgctgattgctacagcatgggagagaacaagatgccttatcagctcaccaagatcagtaagtcagggaggcttcccaaagtgacacctaagctggagtaagagctaaccaggtgacaggaacagaagttgtttcaaacagaaacaggcatctgtatttgcaaatgcttagacagggttggcaaactatggccccatgttcccctctccccctcctttttttttttttttttttttttgagacagagtctggctctctctcacccaggatggagtgcagtggcgtgacctcggctcaccacaacctccacctcctgggttcaaacgattctcctgcctcagcctcctgggtaactgggaccacaggcgcgtgcaagcatgcctggctaatttttgtctttttaatagagagggggtttcagtatgttggcctggctgatctcaaactcctgatctcatgatctgtccaccttggcttcccaaagtgctgggattacaggcgtaagccaccacacctggcttcccctcccctttttatgttgaggtgacattcacaaaacaaaatgaaccattttaaagtgtatgattgaatggcatttaggacactcgcaatgtgtggaaccaaaacctcatcatagttccaaaacattttcatcacccaaaagaaattcctgtgcccattagtcagtccccagtcccctgacccaagtcccctagcagccaccaatcctactttctagctccatagatttactgattctaaatatttcatataaatggaataacaataaaatatgaggccttttgtgcctcacttttttcatttagtaagtttttgaggtttacctatgtgtagcatgtatcagtacttcatttttagggttaaataatgtcccactgtatggatacaccacaacttgtttatccactcatttgctggtgaacatttgggctgtttctaccttttggttattataaaaaatgctattacgaatatctgtgtaaaagtttttgtgtggatacattttcatttctcttaggtagacacctaacagtggaactgctgggtcaaatggtaattctgtgtttaacttttttttattttttgagatggagtctccctctgtcatttaggctggagtgcagtggtgcgatcttggctcactgcaagctctgcctcccgggttcacgcaattctcctgcctcagcctcccaagtagctgggactacaggcgcctgccaccatgcccggctagtttttttgtatttttagtagagacagggtttcaccgtgttagccaggatggtcttgatctcctgacctcgtgatccacctgcctcagcctcccaaagtgctgggattacaggtgtgagccaccacgcctggccttatgtttaactttttgaggaaccaccaaactgctttccacagcatctgaacatttttatattcctaccactaatgtaggagggttccaatttctccataacattgccaacacttcttttcttttcttttttttgagatggagtttcgctcttgttgcccaggctggagtgcaatggcgcgatctcggctcacttcaacctctgccttccaggttcaagcaattctcctgcctcagcctccggagtagctgggattaaaggcatgcaccaccacacccggctaattttgtatttttactagagatggggtttctccatgttggtcaggctggtctcaaactcctgacctcagggccaacacttattttctactttgtaaaaattataaccattcgagtgggtgtaaagtggtacttcattgtggttttgaattgcattttcctaatggctaatgatgtcaagcaagtcatttgcccactttttaactgggttgactttttgttgttgagttgtaagtgttctttgtatatctggatactagacccttatcagatagatgattttcaaatattacatcccaggttgtcttttcactttattggcaatatccttttatgcacaaaagtttttaattctgaagtccaaattatctattttttaattttgttgttcaggcttttggtgctattatatatctaagaatccatgccaaatccaaagtcataaagctttctccttatgttttcttctaagagttttgtagttttaccttctacattgaggtttcagatctattttgagtttatttttgtacatggtgtgaggcaggtgaccaactccattcttttgcatgtggatatttagttgtcccagcaccattcctgaagagactattgtttcaccattgaacagtcttgacactctcatcaaaaatcaattggccacagatgtaggggtgtattcctggaccttacattttttcccattggtctacatgtctattcttatgcccatgaggtgttttgttgttggtaaatgcatgggatttttttatttgttgttttttagtttgtcagtaaagcatatacatgtaactatgatttataatttttgttttatattcttcaaacatgatgatttctttgtaaagaggcataattcccaagagtttttattttgttgttgttgttgtcatttgttttgttttgttttgtttttgaggcagagttccactcttgttgcccaggctggagtgcaatggtgtgatctcggctcactgcaacctctgcatcctgggttcaggcgattctcccgcctcagcctcccaagtagctgggattacaggcacatgccacaactctcggctaatttttgtatttttagtaaagacggggtttcaccacattggccaggctggtctcgaactcctgacttcaggtgatcctcctgccttggcctcccaaagtgctgggattaaaggtgtgagtcaccgtgcctggcccccaagggtatttttaaaagcttaattgagatataattcacataccatagaacttatctatttaaagcaagcttgtccaacatgtggcccagtatagccttgtatgtggcccaaacacaaattcataaactttcttaaagcattatgaacttttggctgggcatggtggctcacacctgtaatcccagcactttgggaggccgaggcaggcagatcacctgaggtcaggagttcgagaccagactgaccaacatggagaaaccccatcactactaaaaatacaaaattagccaggtgtggtggtgcatgcctgtagtcccagttattcaggaaggctgaggcagtagaatcgcttgaacccgggaggcggaggttgcggtgagccaagaccatgccactgcactccagcctgggcaacaagagcaaaactcggtctcaaaaaaaaaaaattatgaatttttttgcaatttttgtttttagctcatcagctattgctagtgtattttatgtgtgacccaagacaattcttcttccagtgtggcccaggggatccaaaagatcagacacccctggtttaaagcataccatccaatgtttcttcgtatactcagagggctgtgcaatcatcactacaacatagttttagaacactttcatcctttgaaagaaaccctattagcattcaatcctcattcctatctcccagactccacctccagtcataggcaactacttatctattttctgtgtctataggtcagactatcctgaacatttcaaataaatggaatcatatagtatgtggtcttttgtgactggcatctttcacttagcttaatatttccaaggttcattcatgatgtatttttagtagagatggggtttcgccatgttggccaggctggtcttgaaatcctgaccacagggtgatctgcctgcctcagcctccctcccaaagtgctgggattacaggcatgagccactgtgcctggcccttctaagagttttataggttcagttcttacatttaggtctgatcgattttgagttttttagtattatgagacagaggtcccatttaatgcttctgcatataaatgtccagcgccccaagaccttgtattgaacaactcctctttttttcactgaactgtcttggcaaccttgtcaaaaatcaattgaccacaagggatacaacactttgattagactggaggaataagttcaaatgatcatgcctataatcccagcactctgggaggccgaagcgggcggattacttgaggtcaggagtttgagaccatcctggctaacatggtgaaaccccatctctactaaaaatacaaaaattagcagtgcgtggtggcacgtgcctataatcccagctactcgggaagctgaggcaggaggattgcttgaacccgggaggtggaggttgcagtgagccgagattgtgccactgcactccagcctcagcgacagagcaagaccctgtctcaaaaaataaaaaaaattaaaattaagaaattaaaattaatgaatttttaaaatatatatttgcactctactgatattattttgattcagagaaatatgttcataacttattagaaataaccttgagtagtttgagaccagcctggccaacacggtgaaaccctgtctctactaaaaacacaaaaaaaattagccaggcatggtggtgcacatctataatcccagctacctggaaggctgagataggagaatcacttgaacccaggaggtggaggttgcagtgagccgagatcgcaccattgcactccagcctggacaacagagcaaggctctgtctcaaaagaaaagaaaaaaaaagaaataaccttgagtaaatttaaatttatttctaagttgatggtatggctaggttttgataatttttatttggtttcccttccctttaatcagaaaattaactttcataccctgttcacaaaccatcaaagctgattttgaaacttaaaaaaaaaatcgccaggtaccatgcaaaagcaatcttccctttagaatgactgatggtatgctaaggtttttcgtggcatattattattaaaggtgaatacaaataaatgggccgggcgcggtggctcacacctgtaatcccagaactttgggaggccgaggtgggcagatcacttgaggtcaggagttcaagaccagcctggccaacatgatgaaacactgtctctactaaaaacgcaaaaattagctgagcatagtggcacacacctgtagtcccagctactcgggtggctgaggcaggagaatcacttgaatctggaaggtggaggttgcagtgagctgagttcgtgccactgcactccagcctgggtgacagagtgagactctgtctcagaaaaacaaaaaaagaaaagaaaggaaaacaaaacctgttttttgggcacatcacttttctgggactcatctgttctttttttttttttttttttaattttagagacagggtcttgttctattgcccaggctggaatgcaaagacatgatcatggctcactgtaaccttgaactcctgggctcaagcaattctcctgcctgagcctcccacgtagccaggactacaggtgcatgccaccacaccaagctaatttgtttgtcatctattctcaagttagtaccacattctattttttttaacttttttaatttttttttagacaaggtctcactctgtcacccaggctggagtgtagtggtgcaatctcagttcactgtaacctccacctcccaggctcaagcaattctcccacctcagcctccagagtagctggaactacaggtgcatgccatcatgcctggctagtttttgcattttttgtaaaaaatgggttttgccatgttgcctaggctggtctcgaactcctgggctcaggttatccaccttcctcaacctcccaaagtgctgggattacaggcatgagtcactgagcccagctagtaccacattctggatcactgtaggtttgtggcaagttttaaaattgggaagtataagtactccaactttttatttgttttatggttgttttggctattctgggttccttgcaattccacataaattttaggatcatcttgccaacttctacaaagaagctagctggtattccaatagagattatgttgaatttgtagaccaatttgaggagtacttccatcctaaaagtattaaatcttcgagtccatgaacatgcaatatttttcgatttagatcttctttaattacttccaaacatgttttgtagttttcagaatgtaacttttgcactttttaaattaaatttacctctaagtattttattctttttgatgttattattaatgagattgctttcctgatttcatttttggattgttcgttgcaaatgtttaggaacacaattgatgtttgcaaactgatattgtattctgtaaccttgttcaatttgtttattagttctaatagttttttactagattccttaggatttccatatacaagcttatgtcatctgcaaatagagacagctttaattcttccatttaaatctagatgcctttttgttttgttttgtttctgagacggagtctcgctcttttgcccaggccggactgtggtggtgctatctcggtcactgcaagctccgcctcccgggttcatgccattctcctgcctcagcctcccgagtagctgggactacaggcgcccgccaccgtgcccggctaattttttgtatttttagtagagacggggtttcaccgtgttagccaggatggtctcaatctcctgacctcgtgatccgcccgccttggcctcccaaagtgctgggattacaggcgtgagccaccgtgcccagcctaaatctagatgccttttatgtttttctcacctaattgccctggctagaatctctagtccaaagctgaacagaagtagcaagagaagacatccttgtcttgtttctgatccttgggggaaagctttcagtttttcaacatgaagtaagatgttagttgtatttgttgtagatgccctttatcagggtgagtaagccaaagtcttaggtcttgtctcccctgtatatctgcaatgccactgccttcatctagtcacacatgcttcatatcttctgggggttgcagaaatggaacagagcgttccagaaatggaagtactccttccctgtttgcgtattcttaacctttctcatacatgtctctattccagaacagactacatggttttgttcctgtatctgcctttcaactagtctcctggcctccagtcttcatggtggtccatcttcaacatcaatgatagcattttttcaattccactatgctgctaagaaggaaaattaattacatcactctcactcaaaacctgctacataattcccattgcctgcagtctggcccccaatcatctctctaagtcttgcccctctagctacctaatatgcttacctataggtatcatccacggtgggtgaccccagactcccagaaagagccattctcctccattctgtgcctttgcatacactgtgtccttccaaagtgcactttaatagctagcaaaatgcatcttagatcccctgtgttgcaggctgtcttgacttaagctgctctctcatggctcccacagtattctcttcaaacatgtgacagttccttaattactagaattgtgcagatacaccttccccactaggctatagacaaatcattcactggtcatcaggattgaatgacgaagatctatgtcccaagtgcaaacatcctgtagtcctcaagtatctggtgactgaattagccaccaggaatgaaaaaaggggacgggcgcggtggctcacgcctgtaatcccagcactttgggaggccaaggcgggcggatcacgaggtcaggagatcaaggccatcctggctaacacggagaaaccccatctctactaaaaatacaaaaaattagccaggcatggtggtgggcgcctgtagtcccagctactggggaggctgaggcaggagaatggcatgaacccaggaggcagagcttgcagtgagccgagatcgcgccactgcactccagcttgggtgacagagtaagactccgtctcaaaaaaaaaaaaaaaaaaagggaggacaaaaagatactgctttcagtataatagaatatgagttagtaacattccagtaagtccttaaaatacagtctaagaactacttcttttttttcccataaaattaaatgctttttagtgtttcaaataagcagcatttacacagaagcagctctatgttaaccatctagatgctgggactttgatacaatacctacagtgcagacacacgggggccagagatgccaggaaggccgcgttgtgtgtgggccgtggtgtgtgcgggcagtgtgtgcaattaccaaggacaggccagctgaccgcccatttccccaagacctccctccctgcggcagctgtgcacatcggggccctttgaccccatgggccacggtccctccctgccctggctgggacgcagtgggcaggatgtctagccctctctcgtcttcccgaaggactacttcttataaaactatgggttccaaattactctataaaattcctcaacaacctctcaaaacagtgctagaaatagtttatacaatgaacatcagtaacctgaaggaatgcagtagtagttaataggccaaaggtaaattaagattatttgatccaagttcagatttctttgtaatctctatttctctcagttccaggcctacttttgccttatacctataaccaactttttttttttttgagacagggtcttgctctgttgcccaggctggagtgcagtggcgcaatcttggctcactgcaacctcaaacccctgacctcaagagatcctcccgcctcggcctcccaaagtgctgggattacaggcatgagccaccgcacctggccctataaccaacttctaatgatttaaccactccattctaatattgggctttgaagttacatcagaccagcccctaaaggcagctcaaggcttacctgagccgagatgcctacgagcagcagccacttctggtactcatcagtccggtagtgaatcacctggcagcccaccagactggtatgtctatcaaacatcttcatgggctgggagtcaccttccatgctccagtggtagaccgcggtctcggtcaccaaggcaacagtgttcacagaaacccatttccagaaaatcacttcttctgccatagtatgagccttcattttactcttcatctcaatattaaagatctgaagtgtcttcccagctagtatttgatataatagagattagagaaagacaaattaaaaatctgaaagacaaattcatatactcttaattctgaattcttttaatattactttaggttgtactgctaatctgattaacagggtctgaaagatgctgccagagtagtaattaagcataccttaatgtctaaatattgagaagagcctgtatgcattaaattcttcttcagaggaatgtaaaagtatgtaactattcatagaaatatgtgaataacaatgagaaattagttctactgaagcaagcctctcttttagattggtttcttctagttttaaaatacttttctggataactcagcaaaaacataagacaccccttctctgtgtggtctccaattttcaagaaagactacaactatcccttcacattaaaccaacttctccaaatttgtcttaaattctagaccaatgctgacaaatggaattttctacaatgttggatatattctatatttgtatccatcacagcagataatagctatatgtggctactaagcacttaagatgtatctagcaagatatttcaggaactgaatttatacttttatttaactttaattaatttaagtgttaaacagccccatgtagctaatgtccaatagggcagtacaattctagacaaaatatttggcatccattctctggcaagagatccatattgtttctacatgtagcaatgaactaaattttgattttggaattatacaaaatttagacctaacataaaatattaaaatattgcttcccacaaagattgggaacaaggcaaggattatttctctgaccacttgttttgatactgagaataacatagctggtgtgataaggcaagaaaaataaaaggcataaagatcaaaaaaggaagtaaagctgtcttaactcacagacaacataattatttacaaagaaaatcctgcagaatctacaaatctacaaaacaactattagaattaatagatgactacaggagtgcagcaagatgcaaagacaacctacaaaaatttcaattgggctgggcacagtggctcacacctgtattcccagcactttgggaggctgaggctggtggatctcttgaggtcaggagtttgagaccagtctggtcaacatggtgaaaccccatctctaccaaaaatacaaaaattagccgggcttggtggcagtcacctgtaattccagctacttgagaggctgaggcaggagaatcgcttgaacccaggaggcagaggttgcagtgagccaagatgatgccactgcactccagcctgggtgacaaagtgaaaacaggtctcaaaaaaaatcaactgaattttgagatactagcagcaaacaatttggaaatataaaaaagaattcaggccgggcatggtggctcacgcctgtaatcccagcactttgggaagctgaggcaggtagattaccggaggtcaggagttcaagaacagcctggccaacatggtgaaaccccgtctctactaaaaatacgaaaattagccgggcatggtggcacactcctgtaatcccagctactcgggaggctgaggcaggagaattgcttgagcctgggaggcggaggttgcagtgagccaaaattgtgccactgcactctagcctgaccgacagagtaagactctgtctcaaaaaaaaaaaaaaaaaaattcataccaccacccaaaacatagcattttggagtaaatttaacaaagggtaagcaaagtctctacactataaaatattcctgaaagaaagtaaaggcttaaataaaagaaggggcataccatgttcatggatcagaacacttaaaattgccaagatgtcatttccccataaattacgtacaggttcaatgcaatcccaatcaaaatcccagaatccttttccttctttctttctttctttttaatagatacagggcctcactttgtcacccaggctggagtacagtggagcaatcatagctcattgcaacctcaaattcctgggctcaagtgatcctcctgcctcagcctctcaagtagttgggactataggcatgcactgccacactcagctaatttttcttttttttttctttttcttttatcttttttttttttttttttttgagacacagtctctctctgttgcccaggctggagtgcagtggcatcatctcagctcaatgcagcctccacctcccaggttcaagtgattctcctgcctcagccccccgagtatcagggattacaggcacatgccatcacgcccacctaattttcgcatttttttgtagagatggggtttcaccatgttggccacgctggtctcaaactcttgacctcaagtgagtcgcctgcctcagcctcccaaagtgctgggattataggcgcgagccaccatgcccagtctaatttttaatttttttttttttttagagactaggtcttgctatgctgcccaggctggtctcaaactcctggcctcatgcaatccttccatctcagcctgtcgaagtgctgggataacaggtgtgagccaccaccctggcccagcatcttttgtttgcttggtggaaaataaaatgatgctataatgaatatggaaatgcagaggacaaagaatagacataacaaatttggaaaagagcaaagctggaagacttacaatacctaatgttgagatgtactataaagctattaataaaacctatgttattgtcataagacacatagatcaatgaaacagaagaaagtctagaaacagctgcatgcactgatttgataaaagtgcctcaaaaaactcaataggcccaaacacattttttataaaaatagaaaaatccattctaaaatgtatatggaacctcaaaggacctcaaatagccaaaataatcttgataaagatgaacaaggttggatgatctcacacttcctgaatttaaacctcattacaaagttaaagtaagcaaatgtatggtaacagcatagaaacacagacaccagtggaatataagagagaactcaaaaatgaaccttcacatatatgatcaaatgatctttgacaagggtactaagaccattcaatgagaaaaaagaatactcttttcaacaaataatactgggaaaactgggtccacaaaataataaaattggacccttaccttataccatatacaaaaagtaactcaaaatggattaaagacctaaacataaaaactaaaatcacaggcagaacctgagtcctgttctctcactttcctccccagacagcatgagtttcaccactcactccactaccttctctactaactaccagtccctgggatccgtccagccgcccagctacagtacccggttgatcagcagtccagccggcatctatgcagatgtaagggatttgggctcccagatctctgtgtcctgctccaccagtttccagggtggcttggggtccagggccctggccactgggatggccaggggtctggcaggaatagggggcatctagaatgagaaggagaccatgcaaagcctgaacgaccacctggcctcctacctggacagagtgaggagcctggagactgagaattagaggctggagagcaaaaaccgggagcacctggagaagaagagaccccaggtcagagactgggccattacttcaagaccactgagaagctgatggctcagatctttgcaaattctgtggacaatgccttcatcgttctgcacactgacaatgcccatcttgctgctgctgactttagagtcaagtatgagacagagctggccatgcaccagtttgtgaggagcgacatccatgggctctgcaaggtcactgatgacaccagtgtcactgggctgtagatgaagacaaagattgagactctcaaggagaagctgttcttcatgaagaaccatgaagagggagtaaaaggcctacaagcccgtattactagctttgggttgactgtggaggcagatgtccaaatatcaggaccttggcaagatcatggcagatatctgggcccaatatgacaagctgactcagaagaacctagagaagctggacaggtactgatcccagcagattgaggagagcaccacagtggtcatcacgcagtccaccgagatcagagctgctgagataacactcacagagctgagatgtccagtccagtccttggagattggcctggacttgatgagaaatctgaagatcagcttggagaacagcctaagggaggtggaggcctgctataccacgcagatggagcagctcaacagggtcctactgtacctggagtcggagctggcacagacctgggcagagggacagcgccaggcccaggagtacgaggcctggaacatccaggtcaatctggaggctgagatcaccacctaccaccgcctgctggaagatggggaggacttcaatcttggtgaggccctagacagcagcaactccatgcaaaccatccaaaagaccaccacctgcaggatagtggacggcaaagtggtgtttgagaccaacgacaccaaagttctgaggaattgagccagcagaagcagggtaccctttggggagcaggaggccagtaaaaagttcacaggttaaaaaaaaccccaacaattaaaatcataaaatgtttagagaaaacataggggaaaagcttgatgacattggatcttgcaatgatttttttggatatgacaataaaagaaaaaaaatgaattggacagcatcagaggtcacaaaagagagaaaaggcaacccacagaataagagaaaatataggcatacctcactttattacactttgttttattgtgtcttgcagatattgcacttgttttgttgttttgttttgtttgagacagcgtttcgctcttgttgcccaggctggagtgcaatggcatgatcttggctcactgccacctctgcctctcaggttcaagagattctcctgcctcagcctctgtagtagttgggattacaggcgcccaccaccatgcccgactaatttttgtatttttagtagagacggggttttaccatgttggccaggctggtctcgaactcctgacctcaggtgatctgcccgcctcggcctcccaaagtgctgggattacaggcgttttttttgttttgtgaacaacaacaacaaaaaaaatcaaaggtttgcggcaatcttccatcaagcaagtctattggtatcatttttccaacagcatgtgctcacttcctgtctctgggtcacactttggtaattctcatgatatttcaaactttttcattattatatttgttatactgctctgtgatcagtgatctttcatgttattacagtaattgttttgtgtcaccatgaaccacacacatataagatagtggacttaataaatgtgtgtgttctaactgctccactgactggccatgccctagtccctcttcctctcttcaggcctccttattccctgagacacaacaatattgaaattaggccatttaacaaccttccttgctaaaggaaagtgaaagtgaaaggaagagtcctacgtctctcactttaagtcaaaagttaggaatgattaggctttgtgaggaaggcatgtcaaaagccaaggcagactgaaggttaggtctcttgcaccagttagccaacttgtgaacacaaaggaaaagttatttaaggaaattaaaagtgctatttcagtgaacacattaatgataagaaaacaaacagccttactgctgatatggacaaagttgtagtggcctggatagaagatctaagcagccagaacaatcccttaagccaaagcctaatccacagcaaggccctaactctctgcaattccatgaaggctgagagaggtgaagaagttgcagaagtctgaagctagcagaggttgattcatgaggtttaatgaaagaagccatctccatagcataaaacggcaaggtgaagcagcaagttctgatgcagaagctgtgtcaagttctccagacgacctagctaagatcattgatgaacaaattttcaatggagaagaaacaacctcctactggaaaaagatgccatttaggactcaagcaagagagaagtcaatgcctggcttcaaagcttcagaagacaggttaactctcttgttaggggataatgcagctggtaactttaaatggaaggaatgctcaccgaccactccaaaaatcctaaggcccttaagaattatgctaaattgactgggcgcagtggctcacacctgtaatcccagcactttggaaggctgaggcaggcagatcacttgaggtcaggagttcgagatcagcctgaccaacgtggaaagaaaccccgtctctactaaaaatacaaaaaattagccgggcatggtggtgcatgcctgtaattccagctacttgggaggctgaggcaggagaatcccttgaactcgggaggtggaggttgcggtgagccaatatcgtgccactgcactccagcctgggcaacaagagtgaaactctgtctcaaaaaaaaaaaaaaaaaaaaaaaaagaattatgctaaatctcctctgcctgtgttctatgaatggaaaaacaagagtcgtgatgatagtacatctgtttacagcatgatttactgaatatttaaaactcactgttcagatctactgatcagaaaaaaaaaaaaaggttcctttcaaaagattactgctctttgacaatgcacctggtcacctaagagctctgacggagatatacaaggagatgaaagctgttttcatgcctgctaacacatcaattctgcaatccgtggatcaaagagtaatttcacctttcaagtcttattatttaagaaatgcattttttttttttttgagacggagtctttgctctgttgcccaggctggagtgcagtggcgtaatcttggctcactgcaagctccgcctcccgggttcacgccattctcctgcctcagcctccccagtagctgggactacaggcgcccaaccatgcccagctaatgtcttgtatttttaatagagaaggggtttcaccgtgttagccaggatggtctcgacctcctgaccttgtgatccacccgcctcagcctcccacagtgctgggattacaggcggaagccaccgtgcccagcctaagaaatacatttttaaaggctacagctgccataaatatgtctcctttgatggatctaggcgaagtaaattgataacctcctggaaaggattcaccattctagatgcaactaagaacattcgtgattcacgagaggagatcaaaatatcaatattaacaggaatttggaagaagtgtattccaaccctcatgaatgactttgtgaggttcaggacttcagtggaggaagtcattgcagatgtggtagaaacagcaagagaattagaagtggagcctgaagatgggactgaattgttgcaatctcaggatcaaacttgaacagatgagggctgcttcttagggatgaccaaagaaaggggtttcttccaatggaatctactcccagtgaagatgctgtgaacactgttgaaattactacaagaatttagaacagtacataaacttacctgataaagcagcaccagagtctgaaaggactgactccaattctggaagaagtctactgtgggtaaaatgttagcaaacagcattgcacgctacagagcaatctttcattaaaggaagagtcaatccctgcggaaacctcactgatgtctttttttaaaattatttattatttatttatttgttttttgagatggagtctcactctgttgccagactggagtgcagtggcgtgatcttggctcactgcaacctccacctcccggattcaagcgattctcctgcctcagcctcccaagtagctgggactacaggagcgtgccaccaggcccagctaatttttttgtatttttagtagagacggggtttcaccatgttggccaggatggtctcgatctcttgacctcatgatctgcctgcctcagcctcccaaagtgctgggattacaggcataagccaccgcacccagcctgatgtcttattttaagaaattgccagcctgtcgcggtggctcatgcctgtagtcccagcactttgggaggctgaggcaggtggatcacgaagtcaggagatggagaccatcctggctaatgtggtgaaaccccatctctactaaaaatacaaaaaattggctgggcttggtggcaggtgcctgtggtcccacctatttgggaggctgaggcaggagaatggcatgaacccgggaggcggagcttacagtgagccgagattgcactactgcactccagcctgggcaacagggtaagactctgtctcaaaaaaaaaaaaaaaattgccacagccactccagccttcagccaccaccactgtgatcaatcagcagccattggcatcaaggcaagaccctccaccagtaaaaagtttacaactcgcagctgggtacagtggctcatgcctgtaatcccagcactttgggaggctgaggccggcagatcacttgaggtcaggagttcgagatcagcctggccaacatggtgaaaccccatctctactaaaaatacaaaaattagctgggcgtggtcgcacgtgcttgtaatcccagctactcgggaggctgaggcaggaggatcccttaaccctggtaaacagaagttgcagagagttgagataacgccactgcactccagcctgggtgacagagagagactccatctttaaaaaaaaaaaaaaaaaagattacaactcactgaaggctgataatggtaagcaatttttaggaataaataaatagattattcatttatttatttatttattttgagacagagtctctctctgtaacccaggctgacatgcagtcatcagactcctgggctcaagatattctcccatctcagcctccttgagtaggtgagactacaggcgtgcaccaccacacccagaattttttttttttttttttgagctaaggtctcactgtattctttgccatgctgctcttgaattcttaggctcaagcgatcttcccaccttggcctctgaaagtactaggattagaggtatatgccaccatgcctggccataaattatttatttttatttttatttttattttttgagatggagtctcactctgtcacccaggctgaagtgcagtggcgcagtcttggctcactgcaacctctgcctcccgggttcacaccattctccgcctcagcctcttgacaggctgggactacaggcaaccgccaccacgcccagctaatttttgggttttgtatttttagtagagacagggtttcactgtgttagccaggatggtcttgatctcctgaccttgtgattctcctgcctcggcctcccaaagtgctgggattataggcgtgagccactgcacccagccaaattattttttaattaagataatccatttttttagacataatgctatttcacacttaatagattacagcatagtataaacataacttttatatgcactgggaaaccaaaaaattcatgtaactcactattgtaatattctttttattgtggtagtttggaattgaactcaaaatatcttcaaggtatgcctgtatatggaaatcatatatctgacaaggggttaatatccagaatatataaagaatgcctacaactcaacaacaaaaaacacaaatagtccagttaaaaaatgacccacgtggagtggttcacgcctgtaatcctagcgctttgggaagctgagacgggatgatcatgtgaggccaagagtttaagacagcctgggcaacatggcaagaccctgtctctacaaagaaaaaatgtttttaattagctggttgtagtggcgcatgcctatagtcctagctacttgggaggctgaggtaggaggatagcttgagtccaggagttcgaagttacagtctcttaaaaaaaaaaaaaaatggctaccattaaaaagaaaacaatacaaataacaagtgttagcaagaatgtgaaaaaattggaaccctgtgcactactgagaatataaaatagtgcaaccactatagaaaagagatggcagttcctcaaaaaaattaaaaatgaataatgatatgatccagtcaattacttgtgggtatagaattaaaaggattaaaaacaggttccccaaaagacatctgtacactcatgttaacagcggaattatttacagatctagctttttttgaggtactactatctctgaggtacacagctagaaaaaaagagttaatctgactatccagttagttagccaagctacgcaacaactgatattattacaatattatcatcaattagcaaaactggttttaaaccacaatttgagaaataaggctgctgttgctaacagaaagtctttaatgatatcatgatatacctgggcaataattaagatgatttcttgaattcacaaaaaggagcaactcaatggtgaaatttcatgcaatttttttttttttgagacagagtttcgcttttggggcccaagctggagtgcaatgggtcgatctaggttcattgcaacctccgcctcccggattcaagtgattgtcctccttcagcgtcccaagtagctgggattataggcatacaccaacatgcccagcaaatttttgtatttttagtagagacagggtttcaccatgttggccaggctggtctcaaactcctgacctcaggtgatccacctaccttgtgctcccaaagtgctgggattacaggtgtgagccaccgtgcccagccgaaatttgatacaatttatatccaaaacacatgatcagtaagataaaggcctgctgccataaaacagttctaaagttagctataactatattatcaacttaagtttaaactatataaatttataaaacaactgcttttggacataatttaggtgtgatgtagttttgctctctagtcaaaatggtaaatgttagaccctcactgtcttcaggcactaacagcttatggtaaatgacttctaatcagactgaactaagatgggagctcaaatccacaaaaagaaataaagagcactggatatgataaatatgttggttagtataaagatttctcttaatttcattaaataatatcatttaaaaccacaataaaactacaggttgttgagtttataacatatatagatgcatatatgcatcttattttctcttttttaatatattttatatattcatatatatgaatgataaaaatagcacaacagagggaggaggaaatgaagctatgctggagtgaaatttctgcattttaacagaagttaatattaataatctgaaatcatttgtgatgttaggatgcattttataaaccctacagcaaccaccataaaaatacacatacatacacaaaatagtaaaaagaaaaattcagaagaattaaaatggtatgctacattttaacaagaaaggcacagggtaggcagctgtgcgcatgttcctgaagcagcctatatacaccttgccagaagtagggtttttcaaaacaatcaagaaaactaacaaatcttatttatttatttttacagacagggtctcactctgttacctaggctggagtgcaatggcactatcccagctcactgtagccttgacataatgggcttaggatgatcctcaagcctcagacttctgagtagctggaaccacagacacgtactaccacactggctagttttttgtttttgttttttaatttgtagagatggagtctccctatgttgcccaggctggtcttgaacttctggtcccaagtgatcctgtcacttcagactcccaaagtgctgggattacaggtatgagccaccaggcctgacccaaaccttagttaatgatcaagaaaaaaacagaagacacaaattatcaaaattaagaatgaaagagggcaccactgccaaccccaaagaaattaaaagaagcgaatattatgaacaattttatgtcaacatactagaagacttagataacctggatacattcctagaaagacacaaattaccaaaactgacacaagaaaacagaaaatctgaacagattcacagcaagtaaggaagttgaatttgaaatttaaaatcttcccacaaagaaaaccccaggaccagaaggctttcactgttgaattctatcaaatactcaaagaagacagaaataagtccttcacagattctttcagaatatagaggaagaaggacctcattctctaaggccaacatttgcctaattacaaagtcacaaaaggacatcacaagaaaagaaaactatagaccaattataaaaataacagaaaacccttagaatattagtgaacaaaatccaacaacataaaaaaaccaccatacaccatgaccaaaagagatttaccacaggaatgcaaggttggcttaatagccaataattaatttatgtaatacaccacactaataaaggacacaaactatgtgatcatctcagtagacacagaaaatagaagggaacttctccaacttgataaaggatttatctaccccaaatccacagccaacatcatatttaattgtaaaaggctaaaaactcccccctaaggtcagaaataattcaacgatttctgttcttgtcacttctgtttaatactgtactgggtattctagccgatgcaatgttgaaacaaacagaatctggattagaaaggaagatgtaaaactgtctattcacagataacatgatacagtatgtagaaaatgccaaggaatccactaaaaactacaagaataagtttaataagtatataggatacagaaaaatatacaaaaattattttatttctatatactagcaagaaacaatccaaaaataaaactaagaaaataagtctgtatataataacataaaaaaagaataaaatacttgggaataaatttaacaaagaagtataggatttgctcactgaatatgcaaaacatcactgaaagaaattaaagatctaaataaacagagacattaaatgactagaagacttaatattgtcaagatagcaattcttaccaaattgataaattcaatgtaatctctatcaaagccccagaaggatttttgtaggaattcacaaactaaacccaaaatttatgtggcaattcaaaggatctcgtttcaaagagtttcaaaaactattttgaaaaacactaagttggagtaccaacactatctgacttccaaattaccataaagctacaactatcaagtaatcggtgcaagaatgggcacagatctgggtcgggcacagtggctcacacctgtaatcccaatactttgtgaggctgaggcaggtggattacctgaggtcaggagttcaagaccagcttggccaacatggggaaaccccatctctactaagcatacaaaaaactagccaggcatggtggcaggcacctgtaatcccagctacttggaaggctgaggcaggagaatcgcttgaacccaggaggcagaggttgcagtgagccaagattgcgcccctgcactccaggctgggtgagaagaacaagactctgtctcaaaaaaaaaaaaaattaaaactacaaaaccataggctaagcactcttagctatgactccaaaagcatgatccattaaagaaaaaaaaaataggtaagttgggctttatcaaaattagtaagttttgcccttcaaaacatatcctatggtttgaatgttttttgttctctccaaaatgcatgctgaaacttcatccccaagtgttgggagatggagccttttgggaggcaagccctcatgttctcacaaaagagcttgatggagggacttaggttcctttttgcccttctgtcacagtgttcctcccctccagaggatgcagcaacaggggccatcttggaagtggagtgtgaacccttaacagacacactatctggtagcatcttaatcttggacttcccagcctccagaactatgagaaataaatttctattctttatagatttcccagtgtcagccatttcattatagcagcacaaacagactaagacaagatgtcattaggagaatgaaaagacaaggtacagactgggagaaaatatatgtaaatcacatagctgataaactatgtatatccagaatatataaagaactcttataattcaataataagatggacaacacaattaagaactgggcaaatatttaaatagacatttctcagaaaatatatataaatggttaataatcatatttaaaaataaaagatatttaacataattaggcattagagaaatacaaattaaaactgcaaaatgctagtacacaaccactggaattgctataataaaaaagatagtatcaagtgttggcatggatgtgtggagaaactggcatcctcatacattgctgatgggtacataaaatgagacagtcactttggaaaacagttgggcagtttcttaaaaagctaaacagggccaggtgcagtggctcatgcctgtaattccagcaatttgggaggccaacgcaggtggatcacaaggtcagatcaagaccatcctggccaacatggtgaaacctcgtctctactaaaaatacaaaaattagccaggcgtggcggcacatacctgtagtcccagctactcgggaggctgaggcaggagaattgcttgaacccaggaggcagaggctgcagtgagccgcgatagcgccactgcactccagcctgggtgacagagcaagactcctcaaaaaaaaaaaaaaagaagaaaaaaagctaaacaggccggtagtggtggttcacgcctgtaatcccagcactttgggaggccaagggggtggatcatgaggtcaggacttcaagaccagcatggctgagatggtgaaaccccgtccctacaaaaaacacaaaaattagccaagcgcaatggcaggtgcctgtaatcccagctacttgggaggctgaggcaggagaatcacttgaacctgggcagcagaggttacagtgagccaatatcatgccattgcactccagcctggatgggcgatagagtgagactccatctgaaaaaaaaagctaaacaaatttatcatatgatccagcaattctactccacccaagagaaatgaaaatatatgtccacatgcacacatatgtttattgcagcactatttacaatagcaaagacatggaaccaacccaaatgcccatcagtgatggactggaaaatgtggtacatacacaccacggaatactatgcagccacaaaaagaaatgagatcatgtcctttgcagggacatggatgaagctggaagccatcatcctcagcaaactaacacaggaacagaaaaccaaacactgcatgttctcactcataagtgggagttgaacaagtgaacacatggacacagcgaggggaacaacacacaccaggcctgtcaggggagtggggggcgaagagagagagagcatcaggacaaagttaatgtatgcagggcttaaaacctagaggatgggttgataggggaagcaaactaccatggcacatgtatacctatgtaataaacctgcatgttctgcacatgtatcctggaacttaaagtaaaattaaaaaaaaaaaaaagaaattgcagaacaacaacaacaaagaaaatatgtccacacaaagacttgtcagtgagcattgatagcagcaatattcttaatagctaaaaactggaaacaatccaaatgtccatcaactggtgaatggaaaaacaaaatgtggcatatccatacaatgaaacactattagacaataaaaaggaacaaactactgatacatgttataacatggatggacctcaaaaacactatgctaggtaaaggaagccagatgtaaaagactacatattgtatgattccatttatttgaattgtctacaagaaagtctgttgaggaagaaagcagatgagttgctgcctcgggccgggagtaggagtgagaatggttctaaacaggcatgaggaaactttctggggttgcagacatgttccaaaactgtattgtagagatgattccacaactctatgaattcactaaaaatcaccgagaaggagtgaatgttggtcgggcacggtggctcatgcctgtaatcccagcactttgggaggctgaggcaggtggatcacaaagtcaagagatcgagaccatcctggctaacatggtgaaaccccgtctctactaaaaatacaaaaaattagctgggtgtgatggtgggcacctgtagtcccagctactcaggaggctgaggcaggagaatggtgtgaacccgggaggcagaggttgcagtgagccaagaccatgccactgcactccagcctgggcaacagagcgagactccaactcaaaaaaaaaaaaaaaaaaagaataagtgaatgttatggtatgtaaattatacttgaaaaaagcagacaaagaaagatataaaaaaaaaatctggaccaaaaattcttggtggtacgctgtcaggatgggggtaccttttagtgtcaagcagccttagatcacagaggaaatttcttctagcttgaaaacttgtcaagttgtccttagcctggtttaaatgaacatgtgtttatgaggcacaaaatattcagcatcactaaaaggaccaaaaaaggaccagccttctttgggaaatacttcaggtcagacttaagtagtctaggtgaggagggggcctccagggggtgccattccccctcttctatcccccactgagctcagtgccaactctgccgcacagatactagattagcctatactccatctacttctaaaaattaagagaaaaaaggtaaagtttgtaaaaagagatacatataaatactgaaaaggtaatgtgatatggtttggttctgtgtccccactcaaatctcatctcaagttgtagttcccagtgttggagagggacctggtgggaggtgactggatcatggaggcagatttcccccttgctgttctggtgatagtgagtgagttctcacgagatctgatgggtataagtgtgtgtgtggctactctggacacactgcctgtgggttagccctgctctgcaaggagcagttaaaaaaaagtgtgtgtgtatggcactcccccttttgttctctctctactgctccgctacggtaagacatgcttgcttccccttcaccttctgccatgattataagtttcctcaggcctcctagccaagcttcctatatagcctatggaactgtgagtcaattcaacctcttttcttcataaattatcctgtctcaggtagttctttatagcactgtgagaacggaccaacacacaatgtttcataataaaattgacaatatcacacctgggccagtaatgcaaggtatctgccaactttccctataaaaggacataaaagacctctgtctgttttgttttgttttgtttttacaactcctcataaaaaccattcttggccaattgaggtggctcacatcagtagtctcaggactttggaaggctgaggtgagaggatcattttaggccaggagtttgagatcagcctgggcaacatagtcagataccatctctacaaaaaatgtttaaacattagctgggcatggtggcatgtgcctgtagtcctagctacttcagaggctgacgcaggaggatcgtttgagcccaggagttcaaggctacagtgagccatgatcacatcactgcattcctgcctggatgacagagagagacctgatcttaaaacaaacaaataaaaaacattcctagttcaggagcaaaaagcagaccgtttgccaatccctcagttaaggtgttccactaaaatcacaagcaacagatgagtaattctgccaccacttcatgctctttaagtcaaaggcaaaatgtatctggttttaaagaattcaccacaaatccgtcagcaaagaaagtatgaacagagactgggtactgggtaagtgaatctgctccaggcttctccagaaagccgggcaatgacgtgggctgagtatctctgagcacttgggagttcacggccaggcatgaggacaggctgcaatggtgtcccttttaatttttttttgagacagagtttcgctcttttttgtttgtttgtttgagacagagtttcgctcttgttgcccaggctagagtgcaatagcacgatcttggctcactgcaacttctgcctcctgggttcaagtgattctcccgcctcagcctcccgagtaactgagattacaggtgcacgccaccacgcccagctaatttttgtatttttagtagagaggaggttactccacgttcgtcaggctggtctcgaactcccgacctccaggtgatctgcctgcctcggcctcccaaagtgttgggattacaggcgtgagccaccacgcccggccttaatttaatttaatattatttttagggacagggtcttgctctgtcacccaggctggaatgcagtggcacgataatagctcactacaacttcgaactcctgggctcaagtaattctccagccttggcctcccaaagcactgggattacagacatgagccacctggcctagccctttttgtaaagggaggtccgagagctgcttcacgagcccctttccaatcacaaaacttcaccagccaaaatgggaaaaatctgtgagatacaaggtgcagcacccccccacacaccctgtatttctgcactggatcctagaagctagtcaaggtgtgtgatatggcagaggactctgaggagctcacttacaaatcaatcatctccatcaaccaatcactatacaaacaactctttcttcaaagacagtttgctcattttggtgtagggccttgaaaacacactgtacatcctccacttgtcaacgatttgtactacaatgatctgagattttactgctacagaattagcagtaaaaataagataaagccttaaaattatgtccctttttggttccagagtcttacacttcccccacggaaaagaaaacaagactcaacatgttatagttgaagtgatctatatgaccattaagaacgaaaataaaaagcagcagcccctgccacctggaagctggcctggcaatcacagcaaggccatgctgctctcctgatggacataaaccaccttggagaacaccagcctcaggcaagggccctctgagaccacgatcaagtgagacacagcaagcacagaaaaaacaaggttactgcgcaactcacaaaataccaacacgcctctctttcagctaaaatgagtgactgctacttctttacccattatagctttaatctcactctagtcttccctccctaatagatgaaatttattgagatacgcaatcataaaaattacccccacttgctgccaacatccaatctacagcaaacccctgcttccttagactaccccctaaatcatccaaccaaagcccaaatcctataaaaggctctaacaccttcttactgagacactccccagttccccatggcgtgtgttctctcccactgcaacagtaaacccaccttcttcaactgcaagtgtgttcctggtggtctttggctggaagggattgacaacatctaactattgcgttctctttactccccgactccacaccacaacacacacacacacaccctaggagctccgcactgcacattgttaaagagaactgtaccagaaaaccaggaagattaaaatgcagatcatttctgagacctgctgaaaacactaaacagcaaacaaaaccgcaaacaacatgctaaataaggcctctcaaaagtactacaacaaggctgggtacagtggctcatgcctataatccaagcactttgagaggccaaggcaggaggatcacttgaggccaggagctcaagaccagcctgaacaacatggtgggacccccttctctacaaatatttttttaagtactacaacaacataaaatgcagaaaagggcgacactgcaaggcaaatattccatcaaaaagagccaaggggtaagtgacaaagtaagagacagataaaagcatcattaatatcccataattgtaataatttctaaccaaaatcatttatactgcttacactatatgttcaaataattactttgacaagattacaagggaaaaggtagggttggtaatagaacaaagatcctttcaaataaaagaatttcagttatttctttttaaatagaaaggtcttaactttcagatgtccttctacctactgaaatgaccaagtagacactatttctgtaataaaatagaagcctaggcaaagctaatatttggcattcacaaattttacctccagaaacagtttttgcttttctttgtttcttttttttttttttttgagaccgatttttgctcttgttgtccaggctggagtgcaatggcgcgatctctgctcaccgcaacctccacctcctgggttcaagagattctcctcagccttcctgaggagctgggattacaggcatgcgccaccacgcccagctaattttttgtatttttaatagagatggggtttctccatgttggtcaggctagtcttcgaactcccaacctcaggtgatctgcctgcctcggcctcccaaagtgctgggattacaggcatgagtcactgcgcccggcccagtttttgcttttcaaagtaagtgatactgcatttcacacaaaacattaagtctactgcatacataatccttttatttgccaaatgaaggcaatataagaagattctatatttttcaagataactagaaggctttaagcacccaagactccctgatttcaaggaagtaaaattctattaattatcagctcctctatcattgatgtgtttcacaggaggaaaacccccgagcctgtgtcgtcggatgaccggaagcaccactgcagcaggccctcaggcaagggggccacacagccttcctgggaaacatgcacagtgctgttgtgcgttcctagtcgcatgaagacaaaggcctgggcattttcttcctctcggtgtgtctggcgctgtgggtgatgttaccaagaagctctggtgctcaggggcctcttactagggcacactaaacataacttttgctaaaacttttggaattaagtggaatactattgaggagcacttcgccatgagcttagtgacacttgttcaatatttaaggtaacaaagcagttaaaatgaggtaagattcctttctaacaatcccatcgggtttacctttcagagctatcaccttagaggctggattcatgatggcactctctgcagagataggccgtcggatcggagccattgggtcactcatgtcaatgatcgtgacctgtgcctgctcaccaactttctctcggatacatatgaacttgtcagattccatggtcagtgtgctgaatccaatgttagctggattaattccaaggttttggagctaaacagaaaaaaagcatttgattaaatttttttcctctgaaatggactgactgtagccaaaggcaaaagaggagaagttaaataaaatttagaaaaaagttaacattaggtaaacacttgaaggaaacattagcttgcttttctacgcctgtaatagatccacccaagcctgtgaatcaactctccttgagagattaccagcccacagtggagataagacatgtgcaggatgacactaggcagtgtcaaggacgccacaagtgatacagacaggaggagatgagttgggggtgaactcccaaagaacaccatcagataaggtgtcacagataagcccaccaccgaggagagctttgggaggaaggaggtcttggagaggtgaaggcgagggaagtggaagggaaaaagggaggaaacacaaaacctgatttctccaaaaggcaagaaaaaagaactggccaaaagtttttgcttaaacatttccctagatatcatcaaacctgtctacatctgacttgaatgaatttctaagtcagtgtgaatacttcctggagagtctggggttaataagaaagtcagcaggtttggcacatcttccagggccgatggactgctactactgtgtaaactgaaaccaagcacctttctccaaaggccatcttatacgcagtgcctgggctaaatcaagacctgctaatgggataagcttcagtgaaaaactctgggaaaacacatactcaataaatgtttatcactcccacaaagcaccaagcttatttctataaatttctctgctctgacctacctacaagacacctttatttacttatttacttatttatttatttattttttgagccggagtctcgctctgttgcccaggctggagtgcagtggtgcgatctcggctcactgcaagctccgcctcccgggttcacgccattctcctgcctcagcctcccaagtagctggggcttcaggcgcccgccaccacgcctggctattttttgtatttttttttagtagagacggggtttcaccgtgttagccaggatggtctcaatctcctgacctcgtgatccgccctccttggcctcccaaagcgctgggattacaggcgtgagccaccgcgtctggtcgacacctttatttttaaacactgttctgttcagccccaattctactgctactgattggaccacttaacatctgttaccttgtgtaaccttgaagaggctcacactagcaacaaagatcatggaccgctgcattaaaattgcaccaccctttggaaggaacacaagtgagactgttcatactgagagtataattcaggacggtgccttgtttgtcttttgtagcagagtctagcacatactggatgttccagctgctgagtggagcaggctacaggacaacaagtcacctcatctcatcttcctgttaacccactgagacaagcatctcacacacactttacacttgggaaaaacaaagtgttggggttaagaaatctttcagaaattacaaagctgattaatgatggagccaggtataataaagcctgtgttctgaccacaatactgagttgtttgaaattcatattccattttaacacagaaaagataaactaagtggtgattatgttcccaaatgagtccaccaaaacaaacaaaaacacatataacagcaaaaaaacaaaacattacttcataactgtagtgaaatagttttttaaaaaatagaacttgccaattgatattgccattattacaagaaagtcccttcatgttccaacgttgggttatagcaaggaaaataatgctaggagtggtttattaagcataggaaaaacctaagtatttttcctgttctcacacatcactcaacacaagactgccaacgccagatgtgggggggtttctccagcagacaccacctagttatcctacaatttaattcaattctgacaatatctacctggaaatagtatcagatcccacaggttgagggctcagtcccataagactgactacacttcagacactaatcgcaagccccaggctgtggcctgtacttctgaccatccagctataaagcagggttcccatgaccttcttcctgggtttgactaatttgttggagtggctaacagaactcaaggaaacacgtttctcatttattacaagggatattacaaaggatactgatgaaccgccagatggaagaggcgcatagagaaaggcgcgaggggtgtccttgcctctcccagcacaccgctcttcagggacctccatgtgttcagctatcatggagctcccgacatctatctacacatcagcaccacattattttatttatggaggttttgtaacatctggtagggcctgccgtcctcagcacttgttacttttggaattttcttaggtattatattgcttaacattttgtaagtctaaaaaaaaattcaagccccaaaataagaacatgggggtcatttgtggcaggcgaagtcatgaaactggacggaagcaccaagagagaccgtgaaaagtgagagaatggtttggaagcccagggcacagagccccaggacacaccaaggcttagaaggcaggcagaagagcagcccatgaagatggacataatttacttaagtaaagttaacatatttaagtaaaccaagaataaaagataacagaagccccataagcacaaccactgatacttagtaaaccaggaaaccacattatcacaaccaaagaaaacctcccagtctcaccacctttttcacaaatgagccatgttcaaattccatcatcctctcctagtttagttccctgctggcttatacaacaacatccaaggtcataaattcctggaggacacagatcagattagtggggtttttgttttgctttgtttttgagacggagtctagccctgtcccccaggctggagtgcagtggcgtgatctcggctcactgcaacatccacctcccgggttcaagcgattctccagcctcagcctcctgggtagctgggattacaggcactcaccaccacgcccagctattttttgtatttttagtagagacggggtttcaccatgttggccaggctggtctcgaactcctgacttgtggtgatccacctgccttggcctcccaaagtgctgggattacaggcttgagccaccacaactggatagattagtgttatttactctgtctgcaattaatagaaaaatcctgaaaaatagaataatataaatgccctagaagttacagtatttatgtatttatgtatttatttatttatttgagacagtctcgctgcgacgcccatcctggagtgcaatggcacaatcttggttcactgcaacctccgcttcccgagttccagcaattctcctgcctcaccctcccgagtagctgggactacaggcatgcgccaccacgctcggctgatttttgtaatttttagtagagatggggtttcaccatattagctaggctggtctcgaactcctgacctcaagtaatttgcctgccttggcctcccaaagtgctaggatttacaatatttattaacaaaacagaggacagtgggattccagaagataagactgctgcatctgaggtttcccctccaaattctacaacattatccatcagatttgtgagccctttgaaaagaaaaacatgaatacctgcaatcaatatgggctcactaagaagtcatgccaaaccaatctaattttcttgaagccaagtaaatgtgatagaataaatcttcatttcagcaaagtatctggcttacctctgctgaggtagccaaagtaactttcacggataatcagtcccctaccccaagccttttatctgtggcatgcttatagaatagagagctttgcgctttgtgttagttattcatatttacttaatctcttgtttcttctcagagtcaaattcattttgaatccatcaaaacatttagcacataaaagcccaaacaatgtatgaaacaaaagactcttggaatgaggtagaaaagcatgaggtgagcttgtgtccacagctgaactgcacctcagtggtgctggccacatggatctgtctgtctgctgccagggcccagagctctgaccttaatcacctgctagtcaatattctgaataatgactctaaccaaagtcatatacagggactgttttatcggctaaggttatgctttgagactgtcaatatactagagtaacaatcagaatcttaacagatttgaaaggactatgaaattaaaaagataaatgtacacaaataaaatacatttgtgttaagtataaaaaaaagatcaaagcttgcttcaaaaagcagctctaatacataaaatgtcaaccaaatgcaatgcataggccttctttggatgctgattcaaataaagcatttgaaacaaatagagaaacaacactgacaagatactggatgatactgagaaactactgattttttttttttaggtgtgatgttattagagttaaaaaataaagaattattagtgtatatcaatggatgaatagataagcaaaatgtgttatacacatgcaataggagtattattcagccttaaaaaggaaggaaattctgacacatgctacaacatgaatgaaccttgaggtcattatgctaagtaaaaaaaaaccaaggtctggtgagatggctcacgcctgtaattccagcactttgggaggctgaggcgggtgggtcgcttgaggtcaggagatcgagaccagcctggccaacacggtgaaaccctgtctctatcaaaaatacaaaaattagccaggcatagtggcgggcgcctgtaatcccagctacttgggaggcggaggcaggagaatcacctgaacccaggaggtggaggttgcagtgtgctgagattgtgccactgtactccagcctgggcaacagagcgagactccatctcaaaaaaaaaaaaaaaaaaaaagacagtcacacaaaaagacaaatattgtatgattccatttatatccagtatgtagaagagtcaaatctatagagacaaaaagtagatggggttggggggaggagtgtgaatggggagtcatttcttaacaggtatggagcacccattttacaagatgaaaagagttgtgggccgggcgcggcggctcacacctgtaatcccagcactctgggaggccgaggcgggcagatcacgaggtcaggagatcgagaccatcctggctaacacagtgaaaccctgtctctactaaaaaaaaatacaaaaaaattagccaggcatggtggtgggtgcctgtagtcccagctactcaggaggctgaggcaggagaatggcgtgaacccaggaggcagagcttgcagtgagccgagattgcaccactgcactctagcctgggcgacagagcgagaccctgtctcaaaaaaaaaaaaaaaaagaaaagagttttggagatggatggtggtgatggctgcataacaatttgaatgtacttaatatcgctaaaatatacacctaaaaatggttaagatgataaattttatgttatgtatattttaccacaattttaaaacttggaaaaaaataacaaagagttctctcttggtgacacatcctaaagtgtttaaggataaaacaagatgtctggaattggcctcaataaaatttggcagtgatcggagacgtaagtaaatcaaagctggccacgtattggtaagcaatcattcttggtcttgtctacctatctggattttccggctttagcaggataggactggatgctctccagacagagcagtgcactgaagtgggcctgggttttctaaattgtccttttgttctcagtttggggatcgatgttgggttaatacggtgacattctgatttcaactccaaataccaagaattggtaatcctgaataatttgtatccaatctcttgagcatagtgggttcttaaataatagtagctgagtcaagttccttatctaagagcatacatacacatgtatggcatttgaaaaaggtaaaagtccctcacaaataagacagtgttttaacaactgagaagagtggatccaaaaataagataaagactattagaatcagattaaattaagacagtagttctcaaccaggagtgctattctgcattcttcagaaatgggaaaggggcggccgggcacggtggctcacgcctataatcctagcactttgggaggtcgaggtgggcagatcataaggtcaagagatggagaccatcctggccaatatggtgaaaccccgtctctactaaaaacacaaaaattagccaggcatggtggcgtgcacctgtagtctcagctactcgggaggctgaggcaggagaattgcttcaacccaggaggcggaggctgcagtgagccaagatcgcgccactgcactccagcctggcgacagagccaagactccgtctcaaaaaaaaaaaaagaaataggcaatgggttcgggcgcagtgggtcacgcttgtaatcccagcactttgggaggccaagacgggtggatcacttgagatcaggagttcaagaccagcctggccaacatggtgaaaccccgtctccactaaaaatacaaaaattagctaggcctggtggcatgtgcctgtaatcccagctactcaggaggccgaggcaggagaacccaggaggtggaggctgcagcaagccaggatcactccactgcactccagcctgggcgacagagcgagactctgtctcaaaaaaaaaaaaagaaaaagaaaaagaaaaaaagaaatgggcaagggtagttttaatagtacaatgagtggggaactcattctctactcatttagccaggaatgctcaatacaggacaatcccacaaaaataacttttccatctaagatgccagatactactgtgagtttttctccatacgcaggaactaagtcccagaaaagtgatgtgctgaaaagccaggttttttctttctttctttccttttttttttttttttagacagagtcttactctgtcacccaggctggagtgcagtggtggcaccatctcggctcattgcaacctctgcctccccagttcaagtgattctccagcctcagcctcccaagtagctgggactacaagtgcccactaccacgcctggctaattttcatattttcagtagagacggggtttcaccacattggccagactggtctcaaactcctgacttcaagtgatccacccgcctcggcctcccaaagtgctgggattataggcgtgagccacagggcctggcccaggtttgttttttttttcactagttagtagaaataaccaaggattcctgatccctagtatattattctgataggtaacctagctacacatttttaaaaaaattttctttctttttttctttcttttgagacagagtcttgctctgtcgccaaggctggagtgcagtggtgcaatcttggcttactgcaaagtctgcctcccacactcaaccgattctcatgcctcagcctcccaagtagctgggaatacaggtgtccgccactgcacctggctaatttttgtatttttagtagagacagggttttgccatgttggccaggctggtcttgaactcctggtctcaagtgatccactttcctcggcctcccaaagtgctgagattacaggcatgcaccactgcactggaccttagctacacattttaaatggcatatataagatttaactaaagaaaggtaaagaagatgctgtctaatgatccttttcagttctcaaagcctgcaattaaatcaatcaaaattcaaatctgacaatgggggccagacatggtggctcatgcctgtaatcccagcactttgggaggccgaggcgggtagatcactggaggtcaggaattcgagaccagcctggtcaacatggtgaagccctgtctctagtaaaaataaaaaacttagctgagcatggtggcacacgcctgtggtcccagctactcaggaggctgaggaacaagaatcgcttgaaaccaggaggcagaggctggaatgagccaagattgtgccactgcactccagcctgggtgacagagacagaccctgtctcaaaaaaaaaaaaaaaaaaaaatctgacactggggaatatgcaaaaagaaattactcatctgatagtcctgtggtttctatgtataaggggcttaaggaagatgtctgcctgggaggactacaactgtgtttgtacaagagtattagtgagaacatcaactgcctacatcagtgaagccagaatgcttaagttgcactgaacatccccatgttttcacacctatgtggacaccaatattttttctttctgtatctgtctccttcccagtctcactcactgctttatccttgtgcctagcatatggatggtaaacaaatagtaaaacaaattacttgtttcagggcagtaaaatttagttcatctacagtttttaaaacatactttgagggcctggcgtggctgctcacgcctgtaataccagcactttgggaggccgaggcgggtggatcacctgaggtcaggagttggagaccagcctggccaacataatgaaaccccatctctataaaaatacaaaaatcagctgggtgtggtggcgggcacctataatcccagctacctgggaggctgaaacaggagaatcacttgaacacgggaagcggaggctgcagtgagccaagaccacgccattgcattccagcctgggcaacaagagtgaaactctgtttcaaaaaaataaatgggctgggtgcagtggctcacacctgtaatcccagcactttgggaggctgaggtgggcggatcacgaggtcaagagattaagaccatcctggccaacatggtgaaaccccatctctactaaaaatacaaaaattagccaggcatggtggcacgcacctgtagtccgagctactcaggaggctgaagccaggagaatcgcttgaaccggggaggcagaggctgcagtgagctgagatcatgccactgcactccagcctggtggacagagcgagactctgtctcaagaaaataaaataaaaaacacattttatatttgaaacacgctgggcgcggtggctcacgcctgtaatcccagcactttgggaggccgaggcaggcggatcacaaggtcaggagatcgagaccatccttgctaacacggtgaaaccctgtctctactaaaaatataaaaaattagctggacgtggtggtgggtgcctgtagtcccagctactcgggaggctgaggcaggagaatggcgtgaaccctggaggcagaggttgcagtgagccgagattgtgccactgcactccagcctgggcaacagaacaagactccatcttaaaaaaaagaaaaagaaaaagaaaaagaaacttaccaaagagcctttcctagcctaaagagggagctctgtaaatgagggcctatgaagaatgttgacactaaggtctcttccagaacttacattccaggagtaggttagttcagggatagttaactacatttatataatgctttacagaacttctctcaaattacactattacaggttttctttattttaacaccagtgcacaagactctatatttatcccagttaaatgtcaactagctggattctggcctgtcaagatatatccgattctaatttcatcactgaactttgctatcccagctttgtggcatccttcttcagcctgccaagagtgatggtcatctctctggcatggaggccagcagcaggcctcaagagaagtggaagaaaatgtgggagaagagcctgcaaactcagtaaagtctcagtgaagaagcaaaggaaggaaaaatcagacagattgcagaaagattcccccttagagaagggggtgacagggtgccagcaactactaccctagggaatactgataaacaacatgtcagatagatgcagtgatctgtctgtgatcctatgggaggatcttcagtgtgttaagttacaaaagcaaagggcagaagcatatttaaagcaggattcttttgaacatttttggaaggatatggtggcttcgtttatagtggtttcccctggggagagacagacagaggctgaactgaaagattttaattcccatcagactagcccctgcaacagaaatatctcagcagagaggaaccttgactcagatcctcctaggacttaattctttcaacccaaccaactaaaaaagcactggtttgtgtagcttaggcattctgaacatttaaatgttctatggtgaagatctgtttttccaaagagtccccattcaaattcatttactctttggtcacccacaatgccacagcggtaggtactcccacaaggctcaccctcgcagacaccctggctgaggcaggttactctccttgctttgtaaataaacaagtcagaaggcaactaactggccagtatgtatttccaataccagaagcagtggtaggccaacaggcaaaatttaacagtttacatggtatcttaaaatgacattttacatgggatgcaataattttaggatgcaatgagccaactgctgtcttagtacatcaaaaaccacttcacaaaatgagatagctacataatggcaacataaaccaaatatggactggattactatgggtacgtgtccctttttggagcatgacccccagaagcctctccagacacacacgggtgtgtgtggatgggaactgttttcagttcaagctcaatctacaccttcacagttttactttcccccctctttccttaatgattaatattgactaacatgtagaaggctgtttcacctgggctgtgtgtaagactcacctgggaaggaataccaaagctccatctccaccactcagagctttggatttaacatccagcagaaatatgtttaaggctgcaggccattctcacatgcagcctaggtagagaagcactgattaagatcttgaccatctttctcctacaattctaatgctcaaggtctctacacctgtttcaaacaccgcctcagagacactttgagggaacatgtttacgttttctgtgtattgagctatgacacatttcacagcttacaaacttggagctgcttttttgatatagctggggggaattacttagggctcaagaaaatttttatgtcaccaaactattcagccattcctcttctgaatcaagatgtcttaagtgctcagcccatcctcagatattacaaacagcaatacccttccaactctcacatttgaatatttctaaaaagttcaaatggtagctccctgagctcacaatccagcagagaaaatgaacagctacagtaccctgggaagagtgtcattataagaggaaccccaaagaggcacagaggaagaactcctaactgacaaatcagggagagcttccagagacagcgtcatttccacagataccagaaggctcagtaggagtcagtgagtaaagaggggtgagaggagaatgtgttttggcaaggacacaaagggagcggcagcagagttgagcaggtgttgggctgggaagaacaggaaagagcacgtggggatcagtcttttcatgccagaggaaacacgaaaccactccctgaaggactttaagcagatgctcatccttggagatcatgttgcctgtgtgctggagaatggatcacaggagggcaagactagaagtagaaggacaaagctagcatgaccatcaaggtggggagggatggcatagtttagggaaacggtagtcatgatgacagtggcagaacgatgccaaaagtaaacaggagaaagggacaacaggatggggaaaacacatcccaggctcctggctggacactggacaagatacacatctggggagaaagggaaccccatttatgaacactgtgtttgaggaacctgctgaccatttcctggccttcttcagtaggcagctgtcacaatggcagcaacagctcacaaggacacagtgctttacagtagtcccttcttatccgtggtttttttcacactgttacctatagtctgaaaatattaaatgtaagaccccagaaataaacaattcataagttttaaattgcataccattctgcagagtgatgaaatcttgcaccagcccacccaggacgtgaattatccctcctctgcccagcatatccacgctgtagacattgccagcccattagtcacttagtagcggtcagttaccaggttgactgttgcagcatcacagagtttgtgttcaagtaacccttaatttacttaataatggccccaaagtccaacagtagtgatgctggcatattgttattattgttctgttttattattagttatcattgttaatctcttactgtgcttaacataaattcagctttatcatacatatgtatgcatagggaaaaaaagtgtataaagggttcagaacaatctgcagtttcaggcatcctctgggggtcttagaacatattccccatgggtaaatcgggactactgtattatgtaacagttattgtttaatgctttacatttattaactcaaaaacctcacaactaccttgtgagataagaagtataccttttatccttattttatagatgaagatatagaagcacaaaaaagctacaaacattgccctaaatcacacagccagtaagtgcctgagtccacattcagtgccttcagtttggcctcagtctgtgctcttaaccaggacctgctactgcctcacacacacacagcagtgaaactgcgaaaacactcggatggcttgggaacatcaagcttatgggaatacataacatcaccagcagcatgtcctgaatgaaaaagcagaggggctcaagacagattccaagctcatgcacaagagccgcccatggggcagtgggtgtgggcagagaggaaggagaaaccctgggaaactgtggaaccaaaaacagtagagaaaggaccctcaggaggcagtaaagtgcagcatcaaatgcggctggacatcacagaagatgcgtgtggtgtgatgggctttatctcacctagctcatcgcatcttattttttgagacggagtctcggtctgttacccaggctggagagtagtgacatgattttggctcactgcaacctctgcctcccgggttcaagagattctcccgcctcagcctcctgactagctgggactacaggtgcgtaccaacacgcccggctaatactgtatttttagtagagacgaggtttcaccatgttggccaggctggtctcgaactcctgatctcaggtgatccacccgcctcggcctcccaaagtggtgggattacaggtgtgagccaccatgctcggcctgattttattttttacagcaaagattagccaactgcagcctgcttttgtatggctaaactaaaagtctttttcatatttttagaaggttaaaaaatgtaagaatatgggacagagacagaatgtggcccttacaaaaaagcctgcaggatggcttgtaaccttggcaaaaacagattcaggggaaaaaatggggacaaaagccagactgcaggttactgtggaacataaaaataatgaagcactaaagcagctctttcatgacatccagctatgagacaagagcttcgtggggacaagagcgggggaagaagtttgctggttgtacagatggaagagaggtgagcattgcccaacacaaacaggaagaaacaacaagacagaaggatgaaaatacaggaaagggaggctatgactgaacgaggctcccttatagggaagaaggataccagatccagaacatagacaagaaaggacacctacttttgaggtaacaggaaggcaggaaagggtggctgcagacaaacatctaagtctgcagccatataggtgagaaacatcccagttatggcttcagttttctccaagtcatctgctggttgcaaggcaggagtggcaggatcagggatttaaggaacaggctgaagtctcgaaatgtctgtagtgaaggcagtgtgtgctgactcagtgtttgctctacagaatgcacagcagcctcaaagacccagtcagtgttagagaccacaaaccagacttgcattcacgtggctgcccaccacaagccacaagcattttccagataatggaacatatcaactctgatggacattacaaatcctgatggacattagaaactctgatggacacctaaaatatcttgttgctttcttgccctttgaaaagaacatatttagatagtggttaagcacaggcattggaatcagacctgggttagaactcaagctttgtcacttactagccatgtaacttttgctgaaggaattagaatattaacctcagtgacccatggtagaaaacaggatatcactatctgcctcagttatcatgaggattaaattaaaccagatttataaaatacagtagtctagtgagtggcaagagaaacggctcagtaaatgataactacatcatcatcattattatgagcagcagcagtattttgctacctcaacatgactggtgctggcttagcttagtggcagaatgaagcccggacagatgtcagggcactcccacctccatacaacttccactgtgtcactaaccaagtgaccctggcaggatcccctggatatcaagtttccagtctgcagaatgaggggactggactgcactacacagttcccaaggcttttcccgtctgcatctagggctaacagtgctctgcactgtgaaaataggaactttcaagcaagcacgttcctcgatgtactactttgtggtcaaaaagacttgagtctgaatcctgttcttattgaatgaagatgagttctttaacacttttgagactcggtttcctcatctagaaaagagtaagcgaatcgcaacgaatggtagtgtgatgatttaacacagagcactcagggaggagccgctggctatccctcctctgccgcacctcccagggtaaacgtggggaccagcaccgctcccgggcagacccgcgagcggcccgcacgacgcccgacctgagcctttgctcaaagcagggggccagtccttatgtttctgaacacaaacaaatggagaacaaactgggaccttattaaaaaggcaggctttgggggtgttactgcattgaaaagccctatttaggcttggccctgagaaatttttctcttgggtcacgcatgttcacggtcctcccaggcgaagccgccctggggacgaaaaccgatcacagaggcaaactcaggggcgaataaggaccgcaggacgccaaggaggggcgtggagctgtgggatccgcgcggcccttgggttgccctgcctgcagcgggaatttgtgtgcctcctcgcgggcactgagcggggcgtcccagggggcgttggcttccacccccaccattccccagccggccccgccggtaacgggcttcggcgacggcacccaagcgggtcctcaggagcggccgccgcgcccgggacgccgcagccccagcccaggtgggaggtcggaaatcggcgcggccagctgggcagcggctcagcggggctgggggcgcggggtcaagcctggcagtccggcccggcggaggcgcggctgacagggcagccccccagcccgccgggcctcacctggaagtgctcctgaaagcgaacagggaggatctgcgccatggctggtgcgggacctcggcggcggcggcggcagcggcaggaatgaacgccgacccctcgcgcgggctgaccggt

SEQ ID NO: 1035 - DNA, 112253 bp, Homo sapiens; identical to SEQ ID NO: 1034
  misc_feature (11154)..(11154): n is a, c, g, or t
  misc_feature (11174)..(11174): n is a, c, g, or t
  misc_feature (11176)..(11178): n is a, c, g, or t
  misc_feature (11180)..(11181): n is a, c, g, or t
  misc_feature (11183)..(11183): n is a, c, g, or t
  misc_feature (11278)..(11278): n is a, c, g, or t
  misc_feature (11282)..(11282): n is a, c, g, or t
  misc_feature (11288)..(11288): n is a, c, g, or t
  misc_feature (11298)..(11298): n is a, c, g, or t
  misc_feature (11325)..(11325): n is a, c, g, or t
  misc_feature (11329)..(11329): n is a, c, g, or t
  misc_feature (12533)..(12533): n is a, c, g, or t
  misc_feature (26940)..(26940): n is a, c, g, or t
  misc_feature (33649)..(33649): n is a, c, g, or t
  misc_feature (33655)..(33655): n is a, c, g, or t
  misc_feature (38411)..(38411): n is a, c, g, or t
  misc_feature (38415)..(38415): n is a, c, g, or t
  misc_feature (38463)..(38463): n is a, c, g, or t

SEQ ID NO: 1036 - DNA, 28236 bp, Homo sapiens
cggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagaggtgagagcgctggctagaccggggccgaatgcggccggattcggggcgggggccttcagacctagggtggaacactgggatagggtgtggggaattcggaccgctgtgaagtgatctgacgttgggtgggagtctccggacttggggtggggaatctggatgggaactggggaattcggaccttgggtggggatctttggaccggggtggggtccccagactccttgtggaaagctgaggttgaagatctgtgctgtgatgaggggctccagatagcggtgagagatcccgcttcaagactgggttgggggtccagaccaggaggataagcctctccctggagtagggcttgacctggtgagggtgtggtagagtcacaggggagggtcccacttggtccttgggctgggatcagactctcagagctggagagttgcaggaggcctgggggagggtctgtggagccccagactcagagggccttggtgacttctccaacaggctccctgttggaggccttggggtaccccagggcctttccctgcaagagagaggctgctccaccaggaaggggcccaggactccccagggtcggggggatgtgtggtgtgcaggaccacgtgggaatgttagagaaaggggaagtcactccgggcctgccctgctaacagacctgctttttggatttttccagccagggatttttgtgtcctgttgctttttattgtttaaagtgaccctccaagcctgagggaccgtaggagctgccctgcagagcccagtgagacactagttaatgcagaaaaaacagattttacttggtaactactgacaacatgagaaaaagctggctccatgctgatttgtctagatgtgcctggagtttaaagggagagtgagggagtgggaaggggtggggactcagtagagttagggaaacagaaaatcaccaaaactgggaagggagggttggcccctgtgaaaccaactgatctgggtttgccactggggcttaccgaagtcaggcccccaacctcccacagagactgggagacaggggccccatcctcaggtgttggctggaacacacaggaaattcttgtggcagccttgaacttctcaggcaggcactttagagggggctaggatcgttctgggaatgtggccttgagctgttaggagctatgttagtgttcgttccagcctagataggccagggtgaggcccagtggagaaggggactctaaggagcctggctggagtgtggggagggagggtctttgtcagcactccccctgtgcaagaagagcagagacctgcttctttcctctcaacagtccccgtccattttctgttctgtgttgtgttcataaactaccagcgggaccatctgttgagacttggtagcaaaggatttttgctggatgatgcaagcagtcaagcatttaatgaggaaacaaaaataacaggccaggcacagtggctcatgtctgtaatcccagcacttttggaggccgaggaggatcacttgaggccaggagtttgaaacaagcctgggcaacataaagaccccatctctacaaaaaatttaaaaattagcccggcgtggtggcatgggcctatagttccagctacttgggaggctgaggtgaaaagatcgtttgagcctgggaggcggaggctgccatgagccatgatcttgcctctatactccagcctgagcaacagagagcccctatctttaaaaaaaaaaaataataataaaataaaaaaataaaaagaaagaaagaaataaaaacaaagatgaatggagctgttgataaacccagtttttgagcctacagggcagcagttgaggtttctggccgttgggccctaacaaggccagcaggggcactcagggacttcctggtgtgtggtgtgaagtctgtgatgatggcataggcattggtatcccagttgtggttactttctggagagagcatgtggcatgcaggagctggagggggggtcttcctgggcggcctgtgtagcagcagctccaggcacaaaggctgcccctggagaatctgttgtggttctgagttctttcaagtttatatcaagttttccggcttcagtctgcagggctgtttttttcagatcctgggggcaaagggcagctacaagaccacctgagtcccaatagggatttgagttcttggtgacaccaagtcagggaggagacaaattagaaatgtcagtctgaagagagtggtaggtagccagatactgaaggaaagtagatgggaggatttggtaagggctgacgtgtaggaaggcagtgacagtccaagtgacaggcagatcataaaacctcaaggataggccgggcccggtggctcatgcctgtaatcccaagcacttcgggaggccgaggtgggcaaatcacccgagtccagaagttcgagaccagcctggctaacatggcaaaaccctgtctctactaaaaatacaaaacattagccgggcgtggtggtgcactcaggaggctgaggcgggataatcgcttgaactgggaggtggggggctgcagtaagccgagatcgcaccactgcactccagcctgggcaacaagagcgaaactccatctcaaaaaagaattaggccgggagcggtggctcacgcctgtaatcccagcactttgggaggccgaggcgggtggatcacgaggtcaggagatcgagaccatcctggctaacacggtgaaaccccatctctactaaaaatacaaaattagccaggcgtggtggcgggcacctgtagtcccagctacttgggaggctgaggcaggagaatggtgtgaacccgggaggtggagcttgcaatgagccgagatcacaccactgcactccagcctgggcgacacagcaagactgcgtctcaaaaacaaaacaaaacaaaacaaaacacctacaaaagacagtgaactagactaggatctgataactcccaagggggtgttatatttctccactgaagcatagcatttctctttacaaacccttcccttttgattgaagataatcaaagtgagattattcttatttaccaaataattctggtctcattaaatttggcctgattatttacataaatgcagcacgaacagtaattgaccacacaggcctttttaagtttgctgaaacttttaatagggaatcttagattgagctttttaaagccttt[450 bp omitted]aaagataattgcttcaattttgtttagagaagtatcatttactataatattacgagtcattgataggttaagagaaaagggaaaggtttctttctttttttcttttttgaggcagagtctcactctgttccccaggctggagtgcagtggcgtgatctcagctcactgcaagctccgcctcctgggtttacaccattctcctgcctcagcctcccgagtagctgggactacaggtgcctgccaccacgcccggctaattttttgtgtttttagtagagatggggtttcactgtgttagcaaggatggtctcgctctccagacctcgtgatccacccgcctcggcctcccaaagtactgggattacaggcgtgagccaccgtgcccagccggggaaaggtttctttttttaatattcagaaaataaaacataaagagccaacaatattctgaacaaaagtcataaaaagactgtaatcatccttcagcagtttactcagttgcatgcaggtactgaattcttgttctgcttgatcttgggctagcaggtacatgaacccatcttttctcaaccagtggagatcctggctcagtgcagtcatgtgatctcaaagttaagaaatgctgtcacgcccaggtgcagtggctcaggcctgtaatcccaacactttgggaggccaacgtggctatatcacttgaagtcaggagttcgagaccagcttggccaacatggtgaaaccctgtctctaccaaaaaatacaaaaattagccagttgtggtagcagacgcctgtaatcccaactactcgggaggctgaagtgggagaatcgcttgaacccgggacatggaggttgcagtgagccaagatcacgccactgcactccagcctgggcaacacagtgagactccatctcaaaaaaagaaataaagaaatgctgtcagaagcctaccccatggtacctgtcatgggccttttcattggtccctttttgttgaagatgaagcactttgccctgtagctgattgcaagagatttcaggaaagcatcagagtaaaactctaatgacaaaagacttaaaatagtgtagttaaatatctaatgagagatcattacaaaatcaaacgatttacaaggaatgttggttgtttatgacacatagcattttaaataataaccagaatgatgattgctgttatatgaggacatgtcattggcagaagggtattcaccagtttgtgggaactttatacaatatctggaatccttatattaacatttaccaatatgcatgtaactcaaggaagtttaaatagcattaaaaaaaatttttttttagtttttttttttttttttttttttgagacagagtcccactgtgttgctcaggctggagtgcagtggcacgatctcggctcactgcaacctccgcctcctgggctcaagcgattctcctgcctcagccccccaagtagctgggattacaggtgtgcaccatcacacccagctaatttttgtatttttagtagagatggggtttcgccacactggccaggctggtcttgaactcctgaccccaggtgacctgcccaccttggccttccaaagtgttgggattacaggcgtgagtcaccgcgtccggccctaaataacattttttatttgacagcaccttgcatgaaattctgtagggtccagccctacagggtctgtgggtttttctccccgtgtgcagagatgagagatcgtagaaataaagacacaagacaaagagatagaagaaaagacagctgggcccggggaccactaccaccaagatgcggagaccagtagtggccccgaatgccaggctgcgctgttatttattggatacaagacaagggggcagggtaaggagtgtgagctatctccagtgacaggtaaggtcacatgggtcacgtgtccactggacgggggcccttccctgtttggcagccgaggcggacagcgagaggagacagcttatgtcattatttctgtatttcagagacctttagtactttcactaattttgttactgctagttagaaggcatagccaggtacagggtggaacatgaaagcggaccaggagcgtgactgcttaagcacagcatcacagggagacggttaggcctccggataactgtgggcaaacctgacactccacaagaggtggttgagcagagtcttctctaactcccacagggaaagggagacttcctttcccggtctgctaagtaacgggtgctttttctaggcactgacgcaactgctagaccaaggtccgctaagtaacaggcgtcttcccaggcgctgacgttaccactagaccaaggagccctctagtggccctgtccgggcataacagaaggctcacacgcttgtcttctggtcacttctcaccgtgtcccttcagctcttatcactgtatggcctggtttctcctaggttataattgtagagcgaagattattataatattggaataaagagtaattgctacaaactaatgattaacaatattcatatataatcatatctatgatctatatctaatgtaactattcttattttatatattttctttattatactggaacagctcgtgccctcggtctcttgcctcggcacctgggcgacttgctgcccacaaaattcaccattgaaataaacctaattagtttaacatctctcttataaggtcacaggacagatcctttgaggtcttccaggggccctccaggaaatctcaagtcagtctgagatcaagacaatgtcacaggccacatgcagtggttcacgcctataatcccaacactttgggagtccgaggagggaggactccttgagcccaggagtttgagaccagcctgagaaacatgctgaggccctgtctctacaaaacaaaaagttgaaaaattagctgggcatggtggtacatgtctgtagtcccatgtactctgaagactgaggcgggaggatcacttgagcccaggagttcaaggttgcagtgagctgtaattgcaccactgcactccagcctcagtaacagagtgagactctgtcactaaaaaaaatttaggctgggtgcagcggctcacgcctataatcccagcattttgggaggtcaaggtggacagatcacctgagatcaggagttcaagaccaggctggccaacatggcaaaaccccacctgtactaaaaatacaaaaattagctgggcgtggtgccatgtgcctgtggtcccagctacttgggaggctgagacagcagaattgcttaagcctgggaggcagaggttacagtgagcccagatcacaccatggcactccagcctgggtaacagagcgagactctgtctcaaaaaaaaaaaaaaaaaaaaaaaaatttaaagaaactttatacataaatccattcaatgattatgaggtcaattctagccagctttgacctcataacataaaatttcttttctgcagactttcttgaggccaggagttcaagaccagcctgggaaacatagggataactttctgtatccattcacagttgcttttgttttgagacagaatctcagtctgtcacccaggatggagtgcagtggtgagatctcagcttactgcagccttgacctcctgggctcaagcgatcctcctgcctcaccctcccaagtagctgggactacaggcatgtaccaccatgccaggctaataatttttgagtttttttatagaaacagggtttcatcatgtttcccaggcttgtctcgaattcctgggccattcaggctttgtcccatatttttcctctttttgtaattttacttcaggacaaaattacatccctttctttaacaaaaacactctacattctttgcatacttttcatataaaaacacatcctatcttcctcccatactttgtataggaaattgtttccctcattcttattgtttctaggagttttgttttcatatattgattataatttttaaccattagtaaccggtattttttttttaaagagacagcgtcttgctcttttgcccaggctggagtgcagtggcacaatcaggactcactgcacccttgaactcccgggctcaagtaattctccaacctcagccccctaaagcactgagattacaggcatgagtcaccacgcccggccataacttgtattttacaagtaaaactgggaagaagacaattggaaattgtctgtcatttaccagtttgttggcaaattttatgaatataccatcttataatctctagaggtatatcctttttatagtacaatgtttttaagtgccaagtacatgtttattaacagaccagaatacctttagccagtctgtaccatataaaaataagaagccaaaaagtacaaaaagttacgcttaataatgaatgtttcagcactttcttctcttcaggtattatttagatattcaatgaatgtctattatttaacttcacttagtatgactctgaggttgaaagttactgaaaacatcttgtaagcttttttaggccaatatattatcaaacgcaattaacaaaacacaactcactagtttatataagagctagttctcacttttttttttactctattttatatattttttcttttcttttcttttcttttttttttttttttttttttctgtagagacaaggtcttgctgtgttgcccaggctggtcttgaactcctagcctcaagtgatccacttaccttggcctcccaaagtgctgggattacaggtgtgagccaccacccagccctattttatatttttatctgaactgtgtttctggcaaattggacaagttaagggtcacttgctccatgtgaggggaaggctttctacctgtatttgtggataagacctttacgacttgttttgccctgatggatgactacatgtttccagtgagctcagctggttgcttttgtgggtccctgaggcactgcgagcccctgatggggcaggaagcctaaagttccagggaccgtggggagttgaggggctggagggggaagagagaggcctgcagcggggatccacaggtggaggaggccagacttgaagggggtgtctccttcaagagaaagtagggaagtatggaggtgataggaagggagaggcctgagaggagctagtttggggagatctcaagtatcccaaaggagccactgatgttccaaattatccttggtaaagtcacatcaacaaggaaggaagcagacagaggcgcacttgttccttgcagttttgttttgatgtgctgattaaagtagcgcagagggcatgatcagcagggctccagtaagacgctcccacgggaggagcaagaacacagaacagagggggcaagacagctccaccaggagtcaggagtgaatcccctctgggaacgaggcactaggaagaagaacttccagcccaggaggtaggtagcgttcagaagaagcctggggcgggcgcggtggcgcacgcctgtaatcccagcactttgggaggccgaggcgggcgaatcacgaggtcaggagatcaagaccatcctggctaacacggtgaaaccccatctctactaaaaatacaaaaaattagccgggcgttgtggtgggcacctatagtcccagctacttgggaggctgaggcaggagaatggcatgaacccgggggacggagcttgcaatgagccgagattatgccactgcactccagcctgggcgacagagcaagactctgtcccaaaaaaaaaaaaaaaaaaagcctgggactcttagcgcctcagagccttactcagaatcataaaatcattagaagcaatgtctgtcctcactgctgcatccgatattcttccggaccactggatcacaaatcaaaccatgtgactcccgcatgagcaggcagagtggagataacacggatcgctgtgtacactgtgtgctccggttgttgcatccgagggttgatcggatggtggttcccatccagatccaagtcctggcccctgatcacagagaaacacagctggacattaaagtggtgaggacggaaattataatatttggtgaccagtgacaggaggggagagagccgagctccgctccgagttgtgcaaagaagtggggagtggggaggaagaacagtggggactcagtggagtgaggaaagtggaaaattaccaaaagcaggaagggagggttagccttgggaaaccaatctgggtttgccacgggggcttactgaagtcaggcccccagtcccacagaggctgggagacaggggccccatcttcaggtgttggccagaacacaggaaattctcttggtagccatgactttctcaggcaggcgctttgaagggggctgggatcattttaggaatgtggccttgagctgttagaagccatgtgcagtatggcttacacctgtaatcccagcactttgggaggctgaggctggagaatcacttgaggccaggagtttaagaccagcctgggcaacatagcaagacgctgtctctacaaaaataatttttaaaaaattagccaggcactgcggcatgcccctgtgtagtcccagttactcaggaggctgaagcaggaggactgctggagcccaagagttcaaggttgcagcaagctgattgcaccactgcactccagcctgggcggcagaggtgatcacgccactgcactcccgcctgggcgacagagcaagaccctgtctttaaaaacaaaaaggccaggcaggtgcggtggctcatgcctgtaatcccagcactttgggaggccaaggcgggcggatcatgaggtcaggagatcgagaccatcctggctaacatggtgaaaccccgtctctaccaaaaacacaaaaaagttagccgggcgtggtggcgggcgcctgtagtcccagctactgggaggctgaggcaggagaatgccatgaacccgggggatggagcttgcagtgagccgagattgcgccactgcactctagcctgggagacagagcaagactccgtctcaaaacaaaacaaaacaacaacaaaaaaaaaacagccgagcgcagtggctcacgcctgtaatcccagcactttgggaggccgaggtgggcagatcacaaggtcaggagttcaagaccagcctgaccaacatggtgaaaccttgtctctactaaaaatacaaaaattagctaggcgtggtggtgtgagcctataatcccagctactcaggaggctgaggcaggagaatcgcttgaacccaggaggcggaggttgcagtgagccgagatcgcgccactgcactccagtctgtgtgacagagtgacagcccgtctcaaaaaataaataaataaataaataaataaataaataaataaataaataaataaataaaatgaagcagcagcagctttgttagtgtttgttcaaggcctgataggccaaggtgaggctcagccgagaaacgtgctcagaggagcctggccggagtgtgatgggggagtctttgtccaggctgctgccacggtgggcctcaggactcatggcctgggcgctgggggtggggctgccactcagccttgaggagagcaatgaggaggtcagattccactcacatccagtgcggtctggatgcaggcctggcccagagcctggtccagatgctggggctttgtttttttgttgttgtttttttgagacagagtctcgctctgttgcccaggctggagtgcagtggcactatctccactcactgcaacaacctccacctccacggttcaagcgattctcctgcctcagcctcccgagtagctgggactacaggcacccgccaccatgcccggctcattttttgcatttttagtggaaacagagtttcaccatgttggccaggatggtctccaactccagaccttgtgatctgcctgcctcagcctcccaaagtgctgggattacaggcgtgagccactgcacccagccggctttgtttacagtactcagcagctgccaaaatagtccccattcccaggcagggcaggctcccgggctcagtccagcggggcagatggccagcctgcacgtcaccccactaggcatgtccaggccctttctgcccctccctaaaggcacccctgtcctttctgtcccctccacactgagccaagccagcctccactcttgccccaggcctgccctctgctgggagccgggacactgagctcctgccacatgagcaggttgacctgcagggggcctccaagcaggtgccaaggcagaatcggatgtgaccaggagaacacccttgaaggataaagcgaatgtgcgaccaccatgcaggtctggcccatggaagggaggggagggggccccgacggggccacagtaaaggagtggaggggccccacaggcagggatggcccagctggccccctggggctgtgaatctgcaggtgcagtgcagcctcttgcctctctcagcccagcccttgcatctgcctcttggtgtgtctgtgaagacaaagtcaccgtggtccctgcagcacctggcttgaagcaggtgtgcagtccgtgtgaaagccttccctttagctattaggtattgagtcaaaaaaaaaaaaagccttcccctgagcctgggggcctggccccactgaggataccaggcgggggaggctacaggaggctgccctctgcctggccatctgaccttccattctgaccccttcccttccacaccagcccctttccctatgtagggtgcagtctttgttgcaactgctcacctctgccatggtcggatgagagcagccacggacaatgtctgtgcaattgtgcgttttttgttttgttttgttttgagatggagtcccactcttgttgcccaggctggagtgtaatggcaccatctcggctcactgcaacctccacctcccgagttctagcgattctcctgcctcagcctcccaagtagctgggattacaggcatgcatcaccatgtctggctaattgtgtatttttaatagagactggggtttcaccatgttggtcaggctgttcttgaactcctgacctcaggtgatccacccgcctcagcctcccaaaatgctgggattacagacgtgagccaccgtgcctggttgattgtgcgttctgataaagcttcatttacagaaatagcaggtaggcccctcgcagggtgcccagagcaggtgcactgtctcacctcttctcaggtgtcaccggggtgagaggctagtcctctgcctcctccttcctctctgcaggttggagaaatgacagcttcttgtactgggggttatgagacagtggcaggagggggacactcccagagtgctgccagaaagaggcgaggccccatctggatttgatggcatttttattgtggtgttgttttagagacagtgtctgtcgcccaggatggacgacatggtgcaatcatggctcactccagcctccaactcctgggcccaagcaatcctcccacttcagcctcctgagtagctgcagctataggcacaccaccatgcctggctcaatgggtattttgtggccattaaacttctggtcattcctttagattcccagaggctggatggaggtgagtggccagcccctgggtccagagatgagcgcggggcctggctgcagcctgtggggtctcccaggctggcctccaggtgtcctctcagcctgtccacaggcgctgcccaagcgtgtggcctacctggtgctgcctggcctgtctctacgcacctgtactggctctccctggattactggatcgcagtcgaatcccctgccagaatcctggtccccctttatcacaccggatcagccccaaagggcagggcttcttgcagcagttccagcctttgctgggggtttccagccctgttgagcaagccccaggtagggccctctgcagcccccgtgggggacctgtgtgccgagcagagctgccccgtgtgtaaacgcttagaactggcctccttcctgccatctgtgtcctgtttgtcatcacgcctgtggctctatgcttgtctccccgactgggccaccagccctgtgagggcaggatgaggcacgtccaagccacagtggctctcagtgtgcagggtgctgttagcattggttctgtgttctggaatagtgagaacagtgtgccccaaatggccagtggcctttccgagggtcactgcagccgcatgttggccctctgtggagaacggaggatgcacagccatttcagagcacaacctgaggtctcctgagcttgctgtgcagcccagtctttctctccgtggcccctggtagctgtctttctcccaggaggaggagaaagacaccttcctgagcaggaggatgtgggtgaatagagaccaaagtgtcaatcactcttctgacagaggtgatagcagaatgaaaaactgatggaccccagatctttgcaaagagaacaaagtcagtttctagttatctttctttcttttttttctttttttctttttttttttttttttttttttttgagatggagtctcgctctgctgcccaggctggagtgcagtggtgtgatctcagctcactgcaaccgcctcccgggttcaagtgattctcctgcctcagcctcctgagtaaccaggactacaggcacacaccaccacgcccagctaatttttgttatttttagcagagacagggtttcaccatgttggccaggatggtcttgagctctcttttttttttttttttttttttttgagacggagtctcgctctgtcacccaggctggagtgcaatggagtgatcttagctccctgcaacctctgcctcccaggttcaggctattctcctgcctcagcctcctgagtagctgggactaacaggtgcttgccaccaagcctggctaatttttgtatttttagtagagacagggtttcaccatattggccaggctgatctcgaaatcctgaccttgtggtctgcccgccttggcctcccaaagtgctgggattacaggcgtaagccaccacaccaggcccattttctagttatcttttacggattttttaaaatgagcctagaaaccaggtcatataattagtttattttttaatttcttatagagacagggtcttactatgttgcccagagtggtcctgaacgcctgggctcaagtgatcctcctgcctcagcctcccaaagtattgggattacaggtgtggccactgttccagccatagttcatattttaaaggatttttaagagtctcatttcactgatgttacttgcagtatatttatggaaaacattcctgtcttttttttttttttgagacggagtctcactctgttacccaggctggagtgcagtggcgtgatctcggctcactgcaagctccgcctctggggttcacgccattctcctgcctcagcctcccgagtagctgggactacaggtgcctgccaccacacccggccaattttttgtatttttagtagagacagggtttcactgtgttagccaggatggtctcgatctcctgacctcgtgatctgcccgccccggcctcccaaagtgctgggattacaggcatgagccaccgcgcccggccagcattcctgtcttttaaagaaagatgagaccagatgcagtggtgtgcacctgtggtcccagctactcaggaggatgccttgagcctgggagttcaaggctgcagctgcagtgagccttgatcacgccactgcactccagcctgggcaattgaacaggaccctgtctctaaagaaataaaataaaggcagatgaatgtcatctagggtgtgtccaatgtgagagagaatactgaccaggtgacagaggtgatggactctctagctctgcagcagactgctgggcagagaagcttgggcaggcctggcactgaggcccagaagcttcatgctctttagagccagaggtgtcaagcccagctgcctgtgtcctggccgcactgtgaggcactgaggatgccctcacacgtgcatctgcatgtggcgtgcatgtggcaagcatgtgcaggtgctgtgtgggcacgatcatgcctgccctctactgtgctggagaggtaagaccatcagccgtttcacagaggagggaatgtggacctcacgggggtctcatgagcttgcgagccgatggccaggcagccggtgcagaaggttcatccattttgatgaaccgtgaattcatctgtactttattcattttaataactgaatcatacctcattgtatggctctaccatgttttattatccattcaggtgctaacggatggaagggttgtttctacctgttggccattgtggatgatgttgctatgcatattggggtacgagtatctggtttagtccctgttttcaattcttggtatacacctaggagtagaattgctgggtcatatggtagttctattttaacttttttttatttttaatttttgtgggtttttaagaattttttaatatttgtgggtgcatagcatgtttaattttttttttttttttgagacggggtcttgctctgttgcccaggctggagtgcagtggcaggatcacagccctgtgcagcctcaacctcctgggctcaggtgatcctcccgcctcagcctcccaagtatctgggactacacgtgcggaccaccacgcctggctaatttttaagttttttgtagagatggggtcttgccatgtttcccagactggtatgggactcctgggctcaagcaatcctcccatcccaacctcccaaagtgctggaattacagtcatgagccaccaggtctgaccacatgtttaactttttgaagaactaccaaactgttttccacggcattcacaccagcaatgcaagagggttcccatttcatcacatccttgctaacacttgttattttccttaaaaaaaaaaaaaaaaaaaagccagctgggcacggtggctcatgcatgtaatcccagcactttggaaggccaagggggtggagcacttgagctcaggagactagcctgggcaaaatatcgagaccccacctccactccatctctaccaaaaaaaaaaaaaaaaaaaagctgggtgtgcggtggtgcacatctgtcgtcccagctacttgggggggctgaggcaggaggatcccttgagcccaggaggtcgagactgcagtgagctgcgaccgcgccactgcactccaggctgagcgacagagtgagaccctgtttcaaaaaaacaaaaaaaaagcacatttcaaacatacacaaaagcagagagaattcccctcggtcctccggcctgcaccccaccgccccccaccacaggggcattcaaaactgtctttttgcctctctgtaaggtaaggggggactcttgacgctccccagaccacacagccaaagtagggcgatcggatcatagggggtcccgagtcggacactgagctggcgtgcccactctcgagtcctgggaccccaaactaaaggagctgttccttttccccatggagggctgacggggcaaaatcccagggctgggaacatccgagcagctttgagtagcacaggtgggtttctacgtggctttctttaaagggaggcctgattctcggcttttcaggacccgccctccattttctcacttgcctgctctttcgtcctgcgaaactgggcagtggccggtgacagcgcagggtcagccctcggatggccaggtgggcgtgatcccaccctcctccgtggctgggtgggcgtggtcccaaagtcaattggatgtggtcccgcgtccctcccggcccagtgggcggggcctccccttctggggcctcccatcccacaccagcgagcagagaggagggtgggcggggaggccctacggggctggggcggggcggagcggaggtggttagctgtcgggaggtggggtgggcaggggccagggctctgttggtggcccggggcagccagtccctctgctcagggcttcagttcacactcacaagggaatcccagcgctcttctcctctggcggttgctggagggccttgtgaggtggccgtgggcactgtagcccccaggcactgcattgtggcctgggcgtgttggcctttgagcctttggccttgagcacttccccatcccccatggctcttggccgttggggcccagttggccgcagagcctttggccttgagcacttccccagcccccatggctcttggccattggaccccagttggccacagagccgcgggcaggtgggacaggcgggcactgggtgcctccttgcaccagccaggcccagcctgcagagtggagtgggccggtccctcctgccaggcaaaggaagggggcttcgggcccctccctgctgtggcctcctcccctctgctgcctcccactaggccctgggagacactgcctgcagatttatgaacagacagacctagagattagagattcaaaagccaaattcttacacaattcaagtattaacgcagatttggatttataatttgggactccaaggtctaccaagtaatttgctgtttcagaatagcccttttaatttggggtatatatttctaacactgttttttaaatatggagagtaaacaaaatggcccattatctgaccacacaaatactagtagtcattatagataaaccatagcagataaataatagtaaacaaagcaacaggctgtgtcataggaaatccccaccatgaagaaaggagcaaggtggaaagttctggctgcttcaggtctgcatggtccctctccaccatggttccccctgtcatcttcctgccagaataaggacactgtccttagggaagcaccatctcttgttttttccccacgagccctgtgggtcatggcacgtcctgccccgctgggaaacacagtgggccacgggtttccctgcaggcctgggacccttcccaagggtagcagcagaaggcagcacgattcccactcctgcagctgtggacaggggcacccccactgtcactgagccctgcaccgggttccatcacctgctcggggctctggcctttggccttttcctgtgagctgcatgttggccactgtgacctatctgtctcatcatctttttcttactggtttgtgtatgttcttggtaaactagcccttggtcttacacatcatttccaaggtactaaggactcttcaggggaaatacaacttgagcagagtggttccctcctcttgtggttcacaaggtgcaggtgcacacacacatagcccacagggcagtgtggacagggaccaggagactgcccctggggtccctggctgggggacactagtagggatgtcccttggcctctctgaggccttctgctgtctcttctgaggccggaaaggcgaagcactgccctcgccctgctagggaaggctcaggccaggctggccctatccggggaaggggctcaggtatctggaccttggtcatcgccaggttagggtttatgttgatgattatccaaaggcaaaattgatttccacagaaataacatctgctttgctgccgagctcagaggagaccccagacccctcccgcagccagagggctggagcctgctcagaggtgctttgaaggtgagttggccaacggaagccggggcagtgccagggtgggtacagattccggcccggtgcatgggcacaggtctgctgagcacatgtccactctgcctgtgtaaataggccacatggcctgaaatcccctagaagcctggtgtccgcatgacctccccctagggcggagcctctgcttccctgttctcttctgctctgtcctctggtgccctgaggctggcctccaggggtgtcccctctgtggccctaggcctgcctccttgcctgggtgtgcctttctaaaatggagcgtccagcagagagtgggatctcctatgccactgggagcccagggccccatcccagaaagacctctgagtgagcacaggggccctagaagaagtttccttgtgtccttcccgttttagggtctgtgacctgaacccctgggcttctgcctcaggcctcctgtgctctgctctctgcctgctgggtcccctcaccaggcttctgtctggttcccaggctacctgcctggagggtcacaccaggaggatttcaaacaggtttcaagtggggtcacttgccatcactgtgccccacgaggtacactgttgtgggcggcagggctggcctttctcatctgggacatgccacgttgctgttcccaaggggagtggtgagtgggtctgtcctggtgtgcctggcctggggactgccagtgtccttacttggacactcaatgaaaaggccacatgaatccctggggcgtccagagcatgggtgaccagcacgggctcaccacatgaggccaaggggctgcaccatacagcctctcctttggccacccgtgactacccccaactccgggccatggggcttccctacccctgggtgtcctctaagccagctgggagacaacagcctgagtccgtgtctgcttctgtattttgtgtggttttagaggatccctgggctgcctggggaagcacccagggccagggagtgtgaccctgcaggctccacacaggactgccagaggcacacacctgctctgtctacccgagggcaccagagggcacgagaaggctggctccctggcgctgacacgtcaggcaactgaggcacaaggctggcatttctgaaccttgcccctctgcaaacacaagggggcgatggtggcactccaagcaaaggggcgtgtgggtgctgcaggaggagcacagagcactggcgcccctcccctcccgccctgcagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggtggggtccgggccagcaggtgctcagctctgggacagggacccaggaccaggcatcaaagcccttacaggagaagctgttatcaccccatttccagggggctgggaaccctgggatatgcccagatagggctggggggctcctctggagtcccagggtgccagggtccctgatgacccctgcaggccctgctgcctgctgccccaggacaacaggcccccacactcacagggtctgacggtggtgcagttccccttgaactctgttctggccaccatgggacctgcctggggaccagtcagacaggttctcctgggcccgcctcccgcttgaacttcagcctggggcacaggatgtgttaccgggctcacggagtgactcagggaactagtgccgccccagggccccaaggtgggcggttcggtgattcagagagggcagctctgtgttaggacacactggggccagccaggaagggtggaaaagatagggaccagcgtgagcatagaggctaagggaccatgggagctccaagcgcgctcacagtggggaccaggtcctgggggctggggacaccagggaggtgaaatacccctccagcgggtagggagggtgggcagaggagggccagcggccaggcatttgggaggggctcctgctctttgggagaggtggggggccgtgcctggggatccaagttcccctctctccacctgtgctcacctctcctccgtccccaaccctgcacaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtgtgcatgcctgacccgttgtcagacctggaaaaagggccggctgtgggcagggagggcatgcgcactttgtcctccccaccaggtgttcacaccacgttcactgaaaacccactatcaccaggcccctcagtgcttcccagcctggggctgaggaaagacccccccagcagctcagtgagggtctcacagctctgggtaaactgccaaggtggcaccaggaggggcagggacagagtggggccttgtcatcccagaaccctaaagaaaactgatgaatgcttgtatgggtgtgtaaagatggcctcctgtctgtgtgggcgtgggcactgacaggcgctgttgtataggtgtgtagggatggcctcctgtctgtgaggacgtgggcactgacaggcgctgttccaggtcacccttgtggttggagcgtcccaggacatcatcccccagctgaagaagaagtatgatgtggacacactggacatggtcttcctcgaccactggaaggaccggtacctgccggacacgcttctcttggaggtgagccccaaccaggatggcatccgtgccagctgctgcccagagcccattcagtcagcctcagcctctccaaagagccaggcattccagtagagccctgtgtggacacagctcgctctggaggcaccacctgaggtctgggagtgtgggggactgaggaggccctgtggtgggtggagatgggtggggagctgggccaggggcctggctgggtggcctgttgggaactggggagccagctgcctgtgcaggtgcaaaatgggtggcagaagtggggtgcacaccccagaccagacaccagggcagaaacggcacaggaccaaggagatggggtggggaagggccgctctgggcccagcctgctctcccccaagcaagccactgctcgtgcaaagaaagcatgtgtctcctgcagatcttcctcctgaggccccatcttgtgcattcccccaacccagccccactggcgaggaccctgagtgccccgagtgaggctagacagcgggtggggctgtcctcgcttccctggggggcgtggggcactggtggcccttcacagactgatgcttaaggagcctcacatcagtgacacactgccccatccctccctggtggtcagcgacactgagtggctctgtgatcctccactgggcttgggacacccaccctcacggcctccccacctggtgctcgctcacctgcagctctcccagaaactggacactgctgttagcagccggactaggagcacgaggggcacagcccccatgcctggctaggtagggccgctggaccctggacacggattggaaggaaccagcactagcagaagcctgaggtgtgaaagggcagagaatgttccaggaacaatgggagtcagggcacacaggactttgggcaggtgaggatgaggttagacctgtcttctggagctgggctcaggggctcatgcctgtaacccttgcactttgggaggctacggcaggaggagcgcttgaggccaggagagttcgagaccagcctgggcaacatggcaaaagaaaaaatatatatatatattttagatggagtcttgctctgtcaccaggctggagtgcagtggcacgatcacggctcactgcaacctccacctcttgggttcaagcgattaccctgccttagcctcctgagtagctgggactacaggcgcgcgctgccacacccggctagttttttgtagtttagtagagatggggtttcaccacattggccaggatggtctcaatatcctgacttcgtgatccgcccgcctcggcctcccaaagtgctgggattacaggcgtgagccactgcgtccggccgtattccagctttcaaaacaacaaaaaacaacaaaaacttttctggaaagatccctgtcagccttgtggagtgtggagagggctgtggggagggcatttcagatgccctgaactcacgaggaggcactgaaccctggccgtggagagggaggacctgtagtggccaagggggtgggcattgggagggtgggagggagacctacaggccaagacagggtagctggaggggggctcacccctgacaaaggagcatgatgctggcaattgggtattgatggcagagagctggcactcagccagatgggcttcacttgggcaggaaagacacccacagctgggcctgcgttactgcggccgagtttcagcagctgtgatgtgggtgctaattacaggggcctgccttcatagaaaagtagcaaacattgcagtttagtaactaggaaactaatagttttctcagtgctgcttgcgcaaagctggtaattatctcaaaagaagcaaagtcatgaagtgggaagtcatgaattgggaatgggtgtccttgttaaacgcacatctgcacactcagggctggggccctgtgcccccttgtggagggttaggggacaacctggctcttgtgagggtctagccatcccctcagtgggttctgtgagcatcggaggcacgaggggtgaggggctcaggagcaggttgcaattcaaaatcaagggctgctttgaggaggcctctccaccgggctgctgtagtcaccaagtccagcccatgcccaaaggaagaggaatgagttcccccttaaaaaaaaaaaaaaaaaaagaaaaagacagagtcttgctctgtgcccaggctggagtgcagtgatgacatcatagctcactgtagcctcaaactcctgagctccagtgatcctcccacctcagcctcctgagtagctaggactaaaggcatgcaccactacacctggctaatttaaaaattttttgtagaaatggggtctccctatgttgcccagactggtctcaaactcctggcctcaagcgatcctcttgcctcaacctcccaaagtgctgggagtacaggtgtgtgcttggtctgaggctccaactttttgttgttgtttctcgagacagtctctcgctctgtcgcccaggctggagtgcagtggcgcgatcttggctccctgcaacctctgtgaggctccaactcttgaagggaggagagtctaaggagggtgggccagatgaaaaccacctcagcatagtgtcacctgctcctctgacactgtcgcttctccacggcattagattttcagtcctgctcagacgctgatgcatgtttagccagttctccaggtggtctgagtagctggtaggaggcttgcagtgtcgggcgacaggcaggacaggtgctgccttctttcccctcttgaccagtttcgtaaaggagtgggcccctggcagcctccaaaggtgacccatgctcctttctgcccttccctccttctttcctgtttaactcgtgcaggtgcagtggtctggtgtctttcagtccgctgacgtcttctgtatccctgatgaccagattgggctcctgagtcccctggcgcaacccgagaagtccaggagcccaggcccctcactcatgcattccctggcccagactggaaggcagccgccctgctcaaggcctaggccattgtcctcctcccgggtggcgctttgttctacgtcttttcagctgacattgctaggacatttttttttttttctaaatgaaaacacatcatgattcatggtggtacttcctgctcaactccggaccttggggctgtcccctgacctcactgaccttgcagccgtgtggtgtccatactgtcacatgaaagccccctgctttctctgcagcatacaggctggaaacgaccgccacccaccaccaggacagctgcaagccctgtgggactctccaggcccatcccagaggcatgtggggtcggataccagtgtttcaaggcacctgcctgcaaattgattttattatactttagatgtttgagattgcttgttaacttttgtttggtgactaagtcaaatttccaagacaaggtgactggggtgtcccttgccctggtaggtccttcctccccataggcaaacacttcctctcaaggtttcttgtttatgtgatgtaagcaaacccttttctgatagcatagataggcaagcatcctatgaggtttctcccgatagtggaccccacgggccatgccctatggctgcgtgtccagtaacaactccttccttctgcacagaacccaggcagaggaactctgtgtcctcccagggcccaggcactggtgaagatggggggtctgcaaatgcaggagcttggggatgtccagaactgaccccaaggggcaggcttgttgatgggaggtctgccccacctcagccctgcagggtcaccctggtcaggccaatattgtctccagggaccataccagcaacccctctccttgggtgcctctccctcataggcctgagttcctggcactgggtgttgagggccccattgtttccactcacccagctagcatttattgagcacctactgtgtgccacatgctgttctaagggatggatactcctgagatggatacaggagttgatgagagaaaggtccctgtcctcacggggcccatgttctgaaggtggcacccaagtcttgtacagtcctttcctgcaggagtcacgctgggcagaaagtggaaacctggccccaggggctaggcacaggcgtggtgccgtggcctagtgaggagcacccatcctggtttggggcaggttctctgggcacctctgaccctcacctcccccaccccccggtctgtttgcaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataactcgacttagtacatccttctcaactgccattcccctgctgcccttgacttgggcaccaaacattcaaagctccccttgacggacgctaacgctaagggcggggcccctagctggctgggttctgggtggcacgcctggcccactggcctcccagccacagtggtgcagaggtcagccctcctgcagctaggccaggggcacctgttagccccatggggacgactgccggcctgggaaacgaagaggagtcagccagcattcacacctttctgaccaagcaggcgctggggacaggtggaccccgcagcagcaccagcccctctgggccccatgtggcacagagtggaagcatctccttccctactccccactgggccttgcttacagaagaggcaatggctcagaccagctcccgcatccctgtagttgcctccctggcccatgagtgaggatgcagtgctggtttctgcccacctacacctagagctgtccccatctcctccaaggggtcagactgctagccacctcagaggctccaagggcccagttcccaggcccaggacaggaatcaaccctgtgctagctgagttcacctgcaccgagaccagcccctagccaagattctactcctgggctcaaggcctggctagcccccagccagcccactcctatggatagacagaccagtgagcccaagtggacaagtttggggccacccagggaccagaaacagagcctctgcaggacacagcagatgggcacctgggaccacctccacccagggccctgccccagacgcgcagaggcccgacacaagggagaagccagccacttgtgccagacctgagtggcagaaagcaaaaagttcctttgctgctttaatttttaaattttcttacaaaaatttaggtgtttaccaatagtcttattttggcttatttttaa

SEQ ID NO: 1037 - DNA, 19039 bp, Homo sapiens
ctcccacgggaggagcaagaacacagaacagagggggcaagacagctccaccaggagtcaggagtgaatcccctctgggaacgaggcactaggaagaagaacttccagcccaggaggtaggtagcgttcagaagaagcctggggcgggcgcggtggcgcacgcctgtaatcccagcactttgggaggccgaggcgggcgaatcacgaggtcaggagatcaagaccatcctggctaacacggtgaaaccccatctctactaaaaatacaaaaaattagccgggcgttgtggtgggcacctatagtcccagctacttgggaggctgaggcaggagaatggcatgaacccgggggacggagcttgcaatgagccgagattatgccactgcactccagcctgggcgacagagcaagactctgtcccaaaaaaaaaaaaaaaaaaagcctgggactcttagcgcctcagagccttactcagaatcataaaatcattagaagcaatgtctgtcctcactgctgcatccgatattcttccggaccactggatcacaaatcaaaccatgtgactcccgcatgagcaggcagagtggagataacacggatcgctgtgtacactgtgtgctccggttgttgcatccgagggttgatcggatggtggttcccatccagatccaagtcctggcccctgatcacagagaaacacagctggacattaaagtggtgaggacggaaattataatatttggtgaccagtgacaggaggggagagagccgagctccgctccgagttgtgcaaagaagtggggagtggggaggaagaacagtggggactcagtggagtgaggaaagtggaaaattaccaaaagcaggaagggagggttagccttgggaaaccaatctgggtttgccacgggggcttactgaagtcaggcccccagtcccacagaggctgggagacaggggccccatcttcaggtgttggccagaacacaggaaattctcttggtagccatgactttctcaggcaggcgctttgaagggggctgggatcattttaggaatgtggccttgagctgttagaagccatgtgcagtatggcttacacctgtaatcccagcactttgggaggctgaggctggagaatcacttgaggccaggagtttaagaccagcctgggcaacatagcaagacgctgtctctacaaaaataatttttaaaaaattagccaggcactgcggcatgcccctgtgtagtcccagttactcaggaggctgaagcaggaggactgctggagcccaagagttcaaggttgcagcaagctgattgcaccactgcactccagcctgggcggcagaggtgatcacgccactgcactcccgcctgggcgacagagcaagaccctgtctttaaaaacaaaaaggccaggcaggtgcggtggctcatgcctgtaatcccagcactttgggaggccaaggcgggcggatcatgaggtcaggagatcgagaccatcctggctaacatggtgaaaccccgtctctaccaaaaacacaaaaaagttagccgggcgtggtggcgggcgcctgtagtcccagctactgggaggctgaggcaggagaatgccatgaacccgggggatggagcttgcagtgagccgagattgcgccactgcactctagcctgggagacagagcaagactccgtctcaaaacaaaacaaaacaacaacaaaaaaaaaacagccgagcgcagtggctcacgcctgtaatcccagcactttgggaggccgaggtgggcagatcacaaggtcaggagttcaagaccagcctgaccaacatggtgaaaccttgtctctactaaaaatacaaaaattagctaggcgtggtggtgtgagcctataatcccagctactcaggaggctgaggcaggagaatcgcttgaacccaggaggcggaggttgcagtgagccgagatcgcgccactgcactccagtctgtgtgacagagtgacagcccgtctcaaaaaataaataaataaataaataaataaataaataaataaataaataaataaataaaatgaagcagcagcagctttgttagtgtttgttcaaggcctgataggccaaggtgaggctcagccgagaaacgtgctcagaggagcctggccggagtgtgatgggggagtctttgtccaggctgctgccacggtgggcctcaggactcatggcctgggcgctgggggtggggctgccactcagccttgaggagagcaatgaggaggtcagattccactcacatccagtgcggtctggatgcaggcctggcccagagcctggtccagatgctggggctttgtttttttgttgttgtttttttgagacagagtctcgctctgttgcccaggctggagtgcagtggcactatctccactcactgcaacaacctccacctccacggttcaagcgattctcctgcctcagcctcccgagtagctgggactacaggcacccgccaccatgcccggctcattttttgcatttttagtggaaacagagtttcaccatgttggccaggatggtctccaactccagaccttgtgatctgcctgcctcagcctcccaaagtgctgggattacaggcgtgagccactgcacccagccggctttgtttacagtactcagcagctgccaaaatagtccccattcccaggcagggcaggctcccgggctcagtccagcggggcagatggccagcctgcacgtcaccccactaggcatgtccaggccctttctgcccctccctaaaggcacccctgtcctttctgtcccctccacactgagccaagccagcctccactcttgccccaggcctgccctctgctgggagccgggacactgagctcctgccacatgagcaggttgacctgcagggggcctccaagcaggtgccaaggcagaatcggatgtgaccaggagaacacccttgaaggataaagcgaatgtgcgaccaccatgcaggtctggcccatggaagggaggggagggggccccgacggggccacagtaaaggagtggaggggccccacaggcagggatggcccagctggccccctggggctgtgaatctgcaggtgcagtgcagcctcttgcctctctcagcccagcccttgcatctgcctcttggtgtgtctgtgaagacaaagtcaccgtggtccctgcagcacctggcttgaagcaggtgtgcagtccgtgtgaaagccttccctttagctattaggtattgagtcaaaaaaaaaaaaagccttcccctgagcctgggggcctggccccactgaggataccaggcgggggaggctacaggaggctgccctctgcctggccatctgaccttccattctgaccccttcccttccacaccagcccctttccctatgtagggtgcagtctttgttgcaactgctcacctctgccatggtcggatgagagcagccacggacaatgtctgtgcaattgtgcgttttttgttttgttttgttttgagatggagtcccactcttgttgcccaggctggagtgtaatggcaccatctcggctcactgcaacctccacctcccgagttctagcgattctcctgcctcagcctcccaagtagctgggattacaggcatgcatcaccatgtctggctaattgtgtatttttaatagagactggggtttcaccatgttggtcaggctgttcttgaactcctgacctcaggtgatccacccgcctcagcctcccaaaatgctgggattacagacgtgagccaccgtgcctggttgattgtgcgttctgataaagcttcatttacagaaatagcaggtaggcccctcgcagggtgcccagagcaggtgcactgtctcacctcttctcaggtgtcaccggggtgagaggctagtcctctgcctcctccttcctctctgcaggttggagaaatgacagcttcttgtactgggggttatgagacagtggcaggagggggacactcccagagtgctgccagaaagaggcgaggccccatctggatttgatggcatttttattgtggtgttgttttagagacagtgtctgtcgcccaggatggacgacatggtgcaatcatggctcactccagcctccaactcctgggcccaagcaatcctcccacttcagcctcctgagtagctgcagctataggcacaccaccatgcctggctcaatgggtattttgtggccattaaacttctggtcattcctttagattcccagaggctggatggaggtgagtggccagcccctgggtccagagatgagcgcggggcctggctgcagcctgtggggtctcccaggctggcctccaggtgtcctctcagcctgtccacaggcgctgcccaagcgtgtggcctacctggtgctgcctggcctgtctctacgcacctgtactggctctccctggattactggatcgcagtcgaatcccctgccagaatcctggtccccctttatcacaccggatcagccccaaagggcagggcttcttgcagcagttccagcctttgctgggggtttccagccctgttgagcaagccccaggtagggccctctgcagcccccgtgggggacctgtgtgccgagcagagctgccccgtgtgtaaacgcttagaactggcctccttcctgccatctgtgtcctgtttgtcatcacgcctgtggctctatgcttgtctccccgactgggccaccagccctgtgagggcaggatgaggcacgtccaagccacagtggctctcagtgtgcagggtgctgttagcattggttctgtgttctggaatagtgagaacagtgtgccccaaatggccagtggcctttccgagggtcactgcagccgcatgttggccctctgtggagaacggaggatgcacagccatttcagagcacaacctgaggtctcctgagcttgctgtgcagcccagtctttctctccgtggcccctggtagctgtctttctcccaggaggaggagaaagacaccttcctgagcaggaggatgtgggtgaatagagaccaaagtgtcaatcactcttctgacagaggtgatagcagaatgaaaaactgatggaccccagatctttgcaaagagaacaaagtcagtttctagttatctttctttcttttttttctttttttctttttttttttttttttttttttttgagatggagtctcgctctgctgcccaggctggagtgcagtggtgtgatctcagctcactgcaaccgcctcccgggttcaagtgattctcctgcctcagcctcctgagtaaccaggactacaggcacacaccaccacgcccagctaatttttgttatttttagcagagacagggtttcaccatgttggccaggatggtcttgagctctcttttttttttttttttttttttttgagacggagtctcgctctgtcacccaggctggagtgcaatggagtgatcttagctccctgcaacctctgcctcccaggttcaggctattctcctgcctcagcctcctgagtagctgggactaacaggtgcttgccaccaagcctggctaatttttgtatttttagtagagacagggtttcaccatattggccaggctgatctcgaaatcctgaccttgtggtctgcccgccttggcctcccaaagtgctgggattacaggcgtaagccaccacaccaggcccattttctagttatcttttacggattttttaaaatgagcctagaaaccaggtcatataattagtttattttttaatttcttatagagacagggtcttactatgttgcccagagtggtcctgaacgcctgggctcaagtgatcctcctgcctcagcctcccaaagtattgggattacaggtgtggccactgttccagccatagttcatattttaaaggatttttaagagtctcatttcactgatgttacttgcagtatatttatggaaaacattcctgtcttttttttttttttgagacggagtctcactctgttacccaggctggagtgcagtggcgtgatctcggctcactgcaagctccgcctctggggttcacgccattctcctgcctcagcctcccgagtagctgggactacaggtgcctgccaccacacccggccaattttttgtatttttagtagagacagggtttcactgtgttagccaggatggtctcgatctcctgacctcgtgatctgcccgccccggcctcccaaagtgctgggattacaggcatgagccaccgcgcccggccagcattcctgtcttttaaagaaagatgagaccagatgcagtggtgtgcacctgtggtcccagctactcaggaggatgccttgagcctgggagttcaaggctgcagctgcagtgagccttgatcacgccactgcactccagcctgggcaattgaacaggaccctgtctctaaagaaataaaataaaggcagatgaatgtcatctagggtgtgtccaatgtgagagagaatactgaccaggtgacagaggtgatggactctctagctctgcagcagactgctgggcagagaagcttgggcaggcctggcactgaggcccagaagcttcatgctctttagagccagaggtgtcaagcccagctgcctgtgtcctggccgcactgtgaggcactgaggatgccctcacacgtgcatctgcatgtggcgtgcatgtggcaagcatgtgcaggtgctgtgtgggcacgatcatgcctgccctctactgtgctggagaggtaagaccatcagccgtttcacagaggagggaatgtggacctcacgggggtctcatgagcttgcgagccgatggccaggcagccggtgcagaaggttcatccattttgatgaaccgtgaattcatctgtactttattcattttaataactgaatcatacctcattgtatggctctaccatgttttattatccattcaggtgctaacggatggaagggttgtttctacctgttggccattgtggatgatgttgctatgcatattggggtacgagtatctggtttagtccctgttttcaattcttggtatacacctaggagtagaattgctgggtcatatggtagttctattttaacttttttttatttttaatttttgtgggtttttaagaattttttaatatttgtgggtgcatagcatgtttaattttttttttttttttgagacggggtcttgctctgttgcccaggctggagtgcagtggcaggatcacagccctgtgcagcctcaacctcctgggctcaggtgatcctcccgcctcagcctcccaagtatctgggactacacgtgcggaccaccacgcctggctaatttttaagttttttgtagagatggggtcttgccatgtttcccagactggtatgggactcctgggctcaagcaatcctcccatcccaacctcccaaagtgctggaattacagtcatgagccaccaggtctgaccacatgtttaactttttgaagaactaccaaactgttttccacggcattcacaccagcaatgcaagagggttcccatttcatcacatccttgctaacacttgttattttccttaaaaaaaaaaaaaaaaaaaagccagctgggcacggtggctcatgcatgtaatcccagcactttggaaggccaagggggtggagcacttgagctcaggagactagcctgggcaaaatatcgagaccccacctccactccatctctaccaaaaaaaaaaaaaaaaaaaagctgggtgtgcggtggtgcacatctgtcgtcccagctacttgggggggctgaggcaggaggatcccttgagcccaggaggtcgagactgcagtgagctgcgaccgcgccactgcactccaggctgagcgacagagtgagaccctgtttcaaaaaaacaaaaaaaaagcacatttcaaacatacacaaaagcagagagaattcccctcggtcctccggcctgcaccccaccgccccccaccacaggggcattcaaaactgtctttttgcctctctgtaaggtaaggggggactcttgacgctccccagaccacacagccaaagtagggcgatcggatcatagggggtcccgagtcggacactgagctggcgtgcccactctcgagtcctgggaccccaaactaaaggagctgttccttttccccatggagggctgacggggcaaaatcccagggctgggaacatccgagcagctttgagtagcacaggtgggtttctacgtggctttctttaaagggaggcctgattctcggcttttcaggacccgccctccattttctcacttgcctgctctttcgtcctgcgaaactgggcagtggccggtgacagcgcagggtcagccctcggatggccaggtgggcgtgatcccaccctcctccgtggctgggtgggcgtggtcccaaagtcaattggatgtggtcccgcgtccctcccggcccagtgggcggggcctccccttctggggcctcccatcccacaccagcgagcagagaggagggtgggcggggaggccctacggggctggggcggggcggagcggaggtggttagctgtcgggaggtggggtgggcaggggccagggctctgttggtggcccggggcagccagtccctctgctcagggcttcagttcacactcacaagggaatcccagcgctcttctcctctggcggttgctggagggccttgtgaggtggccgtgggcactgtagcccccaggcactgcattgtggcctgggcgtgttggcctttgagcctttggccttgagcacttccccatcccccatggctcttggccgttggggcccagttggccgcagagcctttggccttgagcacttccccagcccccatggctcttggccattggaccccagttggccacagagccgcgggcaggtgggacaggcgggcactgggtgcctccttgcaccagccaggcccagcctgcagagtggagtgggccggtccctcctgccaggcaaaggaagggggcttcgggcccctccctgctgtggcctcctcccctctgctgcctcccactaggccctgggagacactgcctgcagatttatgaacagacagacctagagattagagattcaaaagccaaattcttacacaattcaagtattaacgcagatttggatttataatttgggactccaaggtctaccaagtaatttgctgtttcagaatagcccttttaatttggggtatatatttctaacactgttttttaaatatggagagtaaacaaaatggcccattatctgaccacacaaatactagtagtcattatagataaaccatagcagataaataatagtaaacaaagcaacaggctgtgtcataggaaatccccaccatgaagaaaggagcaaggtggaaagttctggctgcttcaggtctgcatggtccctctccaccatggttccccctgtcatcttcctgccagaataaggacactgtccttagggaagcaccatctcttgttttttccccacgagccctgtgggtcatggcacgtcctgccccgctgggaaacacagtgggccacgggtttccctgcaggcctgggacccttcccaagggtagcagcagaaggcagcacgattcccactcctgcagctgtggacaggggcacccccactgtcactgagccctgcaccgggttccatcacctgctcggggctctggcctttggccttttcctgtgagctgcatgttggccactgtgacctatctgtctcatcatctttttcttactggtttgtgtatgttcttggtaaactagcccttggtcttacacatcatttccaaggtactaaggactcttcaggggaaatacaacttgagcagagtggttccctcctcttgtggttcacaaggtgcaggtgcacacacacatagcccacagggcagtgtggacagggaccaggagactgcccctggggtccctggctgggggacactagtagggatgtcccttggcctctctgaggccttctgctgtctcttctgaggccggaaaggcgaagcactgccctcgccctgctagggaaggctcaggccaggctggccctatccggggaaggggctcaggtatctggaccttggtcatcgccaggttagggtttatgttgatgattatccaaaggcaaaattgatttccacagaaataacatctgctttgctgccgagctcagaggagaccccagacccctcccgcagccagagggctggagcctgctcagaggtgctttgaaggtgagttggccaacggaagccggggcagtgccagggtgggtacagattccggcccggtgcatgggcacaggtctgctgagcacatgtccactctgcctgtgtaaataggccacatggcctgaaatcccctagaagcctggtgtccgcatgacctccccctagggcggagcctctgcttccctgttctcttctgctctgtcctctggtgccctgaggctggcctccaggggtgtcccctctgtggccctaggcctgcctccttgcctgggtgtgcctttctaaaatggagcgtccagcagagagtgggatctcctatgccactgggagcccagggccccatcccagaaagacctctgagtgagcacaggggccctagaagaagtttccttgtgtccttcccgttttagggtctgtgacctgaacccctgggcttctgcctcaggcctcctgtgctctgctctctgcctgctgggtcccctcaccaggcttctgtctggttcccaggctacctgcctggagggtcacaccaggaggatttcaaacaggtttcaagtggggtcacttgccatcactgtgccccacgaggtacactgttgtgggcggcagggctggcctttctcatctgggacatgccacgttgctgttcccaaggggagtggtgagtgggtctgtcctggtgtgcctggcctggggactgccagtgtccttacttggacactcaatgaaaaggccacatgaatccctggggcgtccagagcatgggtgaccagcacgggctcaccacatgaggccaaggggctgcaccatacagcctctcctttggccacccgtgactacccccaactccgggccatggggcttccctacccctgggtgtcctctaagccagctgggagacaacagcctgagtccgtgtctgcttctgtattttgtgtggttttagaggatccctgggctgcctggggaagcacccagggccagggagtgtgaccctgcaggctccacacaggactgccagaggcacacacctgctctgtctacccgagggcaccagagggcacgagaaggctggctccctggcgctgacacgtcaggcaactgaggcacaaggctggcatttctgaaccttgcccctctgcaaacacaagggggcgatggtggcactccaagcaaaggggcgtgtgggtgctgcaggaggagcacagagcactggcgcccctcccctcccgccctgcagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggtggggtccgggccagcaggtgctcagctctgggacagggacccaggaccaggcatcaaagcccttacaggagaagctgttatcaccccatttccagggggctgggaaccctgggatatgcccagatagggctggggggctcctctggagtcccagggtgccagggtccctgatgacccctgcaggccctgctgcctgctgccccaggacaacaggcccccacactcacagggtctgacggtggtgcagttccccttgaactctgttctggccaccatgggacctgcctggggaccagtcagacaggttctcctgggcccgcctcccgcttgaacttcagcctggggcacaggatgtgttaccgggctcacggagtgactcagggaactagtgccgccccagggccccaaggtgggcggttcggtgattcagagagggcagctctgtgttaggacacactggggccagccaggaagggtggaaaagatagggaccagcgtgagcatagaggctaagggaccatgggagctccaagcgcgctcacagtggggaccaggtcctgggggctggggacaccagggaggtgaaatacccctccagcgggtagggagggtgggcagaggagggccagcggccaggcatttgggaggggctcctgctctttgggagaggtggggggccgtgcctggggatccaagttcccctctctccacctgtgctcacctctcctccgtccccaaccctgcacaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtgtgcatgcctgacccgttgtcagacctggaaaaagggccggctgtgggcagggagggcatgcgcactttgtcctccccaccaggtgttcacaccacgttcactgaaaacccactatcaccaggcccctcagtgcttcccagcctggggctgaggaaagacccccccagcagctcagtgagggtctcacagctctgggtaaactgccaaggtggcaccaggaggggcagggacagagtggggccttgtcatcccagaaccctaaagaaaactgatgaatgcttgtatgggtgtgtaaagatggcctcctgtctgtgtgggcgtgggcactgacaggcgctgttgtataggtgtgtagggatggcctcctgtctgtgaggacgtgggcactgacaggcgctgttccaggtcacccttgtggttggagcgtcccaggacatcatcccccagctgaagaagaagtatgatgtggacacactggacatggtcttcctcgaccactggaaggaccggtacctgccggacacgcttctcttggaggtgagccccaaccaggatggcatccgtgccagctgctgcccagagcccattcagtcagcctcagcctctccaaagagccaggcattccagtagagccctgtgtggacacagctcgctctggaggcaccacctgaggtctgggagtgtgggggactgaggaggccctgtggtgggtggagatgggtggggagctgggccaggggcctggctgggtggcctgttgggaactggggagccagctgcctgtgcaggtgcaaaatgggtggcagaagtggggtgcacaccccagaccagacaccagggcagaaacggcacaggaccaaggagatggggtggggaagggccgctctgggcccagcctgctctcccccaagcaagccactgctcgtgcaaagaaagcatgtgtctcctgcagatcttcctcctgaggccccatcttgtgcattcccccaacccagccccactggcgaggaccctgagtgccccgagtgaggctagacagcgggtggggctgtcctcgcttccctggggggcgtggggcactggtggcccttcacagactgatgcttaaggagcctcacatcagtgacacactgccccatccctccctggtggtcagcgacactgagtggctctgtgatcctccactgggcttgggacacccaccctcacggcctccccacctggtgctcgctcacctgcagctctcccagaaactggacactgctgttagcagccggactaggagcacgaggggcacagcccccatgcctggctaggtagggccgctggaccctggacacggattggaaggaaccagcactagcagaagcctgaggtgtgaaagggcagagaatgttccaggaacaatgggagtcagggcacacaggactttgggcaggtgaggatgaggttagacctgtcttctggagctgggctcaggggctcatgcctgtaacccttgcactttgggaggctacggcaggaggagcgcttgaggccaggagagttcgagaccagcctgggcaacatggcaaaagaaaaaatatatatatatattttagatggagtcttgctctgtcaccaggctggagtgcagtggcacgatcacggctcactgcaacctccacctcttgggttcaagcgattaccctgccttagcctcctgagtagctgggactacaggcgcgcgctgccacacccggctagttttttgtagtttagtagagatggggtttcaccacattggccaggatggtctcaatatcctgacttcgtgatccgcccgcctcggcctcccaaagtgctgggattacaggcgtgagccactgcgtccggccgtattccagctttcaaaacaacaaaaaacaacaaaaacttttctggaaagatccctgtcagccttgtggagtgtggagagggctgtggggagggcatttcagatgccctgaactcacgaggaggcactgaaccctggccgtggagagggaggacctgtagtggccaagggggtgggcattgggagggtgggagggagacctacaggccaagacagggtagctggaggggggctcacccctgacaaaggagcatgatgctggcaattgggtattgatggcagagagctggcactcagccagatgggcttcacttgggcaggaaagacacccacagctgggcctgcgttactgcggccgagtttcagcagctgtgatgtgggtgctaattacaggggcctgccttcatagaaaagtagcaaacattgcagtttagtaactaggaaactaatagttttctcagtgctgcttgcgcaaagctggtaattatctcaaaagaagcaaagtcatgaagtgggaagtcatgaattgggaatgggtgtccttgttaaacgcacatctgcacactcagggctggggccctgtgcccccttgtggagggttaggggacaacctggctcttgtgagggtctagccatcccctcagtgggttctgtgagcatcggaggcacgaggggtgaggggctcaggagcaggttgcaattcaaaatcaagggctgctttgaggaggcctctccaccgggctgctgtagtcaccaagtccagcccatgcccaaaggaagaggaatgagttcccccttaaaaaaaaaaaaaaaaaaagaaaaagacagagtcttgctctgtgcccaggctggagtgcagtgatgacatcatagctcactgtagcctcaaactcctgagctccagtgatcctcccacctcagcctcctgagtagctaggactaaaggcatgcaccactacacctggctaatttaaaaattttttgtagaaatggggtctccctatgttgcccagactggtctcaaactcctggcctcaagcgatcctcttgcctcaacctcccaaagtgctgggagtacaggtgtgtgcttggtctgaggctccaactttttgttgttgtttctcgagacagtctctcgctctgtcgcccaggctggagtgcagtggcgcgatcttggctccctgcaacctctgtgaggctccaactcttgaagggaggagagtctaaggagggtgggccagatgaaaaccacctcagcatagtgtcacctgctcctctgacactgtcgcttctccacggcattagattttcagtcctgctcagacgctgatgcatgtttagccagttctccaggtggtctgagtagctggtaggaggcttgcagtgtcgggcgacaggcaggacaggtgctgccttctttcccctcttgaccagtttcgtaaaggagtgggcccctggcagcctccaaaggtgacccatgctcctttctgcccttccctccttctttcctgtttaactcgtgcaggtgcagtggtctggtgtctttcagtccgctgacgtcttctgtatccctgatgaccagattgggctcctgagtcccctggcgcaacccgagaagtccaggagcccaggcccctcactcatgcattccctggcccagactggaaggcagccgccctgctcaaggcctaggccattgtcctcctcccgggtggcgctttgttctacgtcttttcagctgacattgctaggacatttttttttttttctaaatgaaaacacatcatgattcatggtggtacttcctgctcaactccggaccttggggctgtcccctgacctcactgaccttgcagccgtgtggtgtccatactgtcacatgaaagccccctgctttctctgcagcatacaggctggaaacgaccgccacccaccaccaggacagctgcaagccctgtgggactctccaggcccatcccagaggcatgtggggtcggataccagtgtttcaaggcacctgcctgcaaattgattttattatactttagatgtttgagattgcttgttaacttttgtttggtgactaagtcaaatttccaagacaaggtgactggggtgtcccttgccctggtaggtccttcctccccataggcaaacacttcctctcaaggtttcttgtttatgtgatgtaagcaaacccttttctgatagcatagataggcaagcatcctatgaggtttctcccgatagtggaccccacgggccatgccctatggctgcgtgtccagtaacaactccttccttctgcacagaacccaggcagaggaactctgtgtcctcccagggcccaggcactggtgaagatggggggtctgcaaatgcaggagcttggggatgtccagaactgaccccaaggggcaggcttgttgatgggaggtctgccccacctcagccctgcagggtcaccctggtcaggccaatattgtctccagggaccataccagcaacccctctccttgggtgcctctccctcataggcctgagttcctggcactgggtgttgagggccccattgtttccactcacccagctagcatttattgagcacctactgtgtgccacatgctgttctaagggatggatactcctgagatggatacaggagttgatgagagaaaggtccctgtcctcacggggcccatgttctgaaggtggcacccaagtcttgtacagtcctttcctgcaggagtcacgctgggcagaaagtggaaacctggccccaggggctaggcacaggcgtggtgccgtggcctagtgaggagcacccatcctggtttggggcaggttctctgggcacctctgaccctcacctcccccaccccccggtctgtttgcaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataactcgacttagtacatccttctcaactgccattcccctgctgcccttgacttgggcaccaaacattcaaagctccccttgacggacgctaacgctaagggcggggcccctagctggctgggttctgggtggcacgcctggcccactggcctcccagccacagtggtgcagaggtcagccctcctgcagctaggccaggggcacctgttagccccatggggacgactgccggcctgggaaacgaagaggagtcagccagcattcacacctttctgaccaagcaggcgctggggacaggtggaccccgcagcagcaccagcccctctgggccccatgtggcacagagtggaagcatctccttccctactccccactgggccttgcttacagaagaggcaatggctcagaccagctcccgcatccctgtagttgcctccctggcccatgagtgaggatgcagtgctggtttctgcccacctacacctagagctgtccccatctcctccaaggggtcagactgctagccacctcagaggctccaagggcccagttcccaggcccaggacaggaatcaaccctgtgctagctgagttcacctgcaccgagaccagcccctagccaagattctactcctgggctcaaggcctggctagcccccagccagcccactcctatggatagacagaccagtgagcccaagtggacaagtttggggccacccagggaccagaaacagagcctctgcaggacacagcagatgggcacctgggaccacctccacccagggccctgccccagacgcgcagaggcccgacacaagggagaagccagccacttgtgccagacctgagtggcagaaagcaaaaagttcctttgctgctttaatttttaaattttcttacaaaaatttaggtgtttaccaatagtcttattttggcttatttttaa

SEQ ID NO: 1038 - DNA, 18454 bp, Homo sapiens
tggagataacacggatcgctgtgtacactgtgtgctccggttgttgcatccgagggttgatcggatggtggttcccatccagatccaagtcctggcccctgatcacagagaaacacagctggacattaaagtggtgaggacggaaattataatatttggtgaccagtgacaggaggggagagagccgagctccgctccgagttgtgcaaagaagtggggagtggggaggaagaacagtggggactcagtggagtgaggaaagtggaaaattaccaaaagcaggaagggagggttagccttgggaaaccaatctgggtttgccacgggggcttactgaagtcaggcccccagtcccacagaggctgggagacaggggccccatcttcaggtgttggccagaacacaggaaattctcttggtagccatgactttctcaggcaggcgctttgaagggggctgggatcattttaggaatgtggccttgagctgttagaagccatgtgcagtatggcttacacctgtaatcccagcactttgggaggctgaggctggagaatcacttgaggccaggagtttaagaccagcctgggcaacatagcaagacgctgtctctacaaaaataatttttaaaaaattagccaggcactgcggcatgcccctgtgtagtcccagttactcaggaggctgaagcaggaggactgctggagcccaagagttcaaggttgcagcaagctgattgcaccactgcactccagcctgggcggcagaggtgatcacgccactgcactcccgcctgggcgacagagcaagaccctgtctttaaaaacaaaaaggccaggcaggtgcggtggctcatgcctgtaatcccagcactttgggaggccaaggcgggcggatcatgaggtcaggagatcgagaccatcctggctaacatggtgaaaccccgtctctaccaaaaacacaaaaaagttagccgggcgtggtggcgggcgcctgtagtcccagctactgggaggctgaggcaggagaatgccatgaacccgggggatggagcttgcagtgagccgagattgcgccactgcactctagcctgggagacagagcaagactccgtctcaaaacaaaacaaaacaacaacaaaaaaaaaacagccgagcgcagtggctcacgcctgtaatcccagcactttgggaggccgaggtgggcagatcacaaggtcaggagttcaagaccagcctgaccaacatggtgaaaccttgtctctactaaaaatacaaaaattagctaggcgtggtggtgtgagcctataatcccagctactcaggaggctgaggcaggagaatcgcttgaacccaggaggcggaggttgcagtgagccgagatcgcgccactgcactccagtctgtgtgacagagtgacagcccgtctcaaaaaataaataaataaataaataaataaataaataaataaataaataaataaataaaatgaagcagcagcagctttgttagtgtttgttcaaggcctgataggccaaggtgaggctcagccgagaaacgtgctcagaggagcctggccggagtgtgatgggggagtctttgtccaggctgctgccacggtgggcctcaggactcatggcctgggcgctgggggtggggctgccactcagccttgaggagagcaatgaggaggtcagattccactcacatccagtgcggtctggatgcaggcctggcccagagcctggtccagatgctggggctttgtttttttgttgttgtttttttgagacagagtctcgctctgttgcccaggctggagtgcagtggcactatctccactcactgcaacaacctccacctccacggttcaagcgattctcctgcctcagcctcccgagtagctgggactacaggcacccgccaccatgcccggctcattttttgcatttttagtggaaacagagtttcaccatgttggccaggatggtctccaactccagaccttgtgatctgcctgcctcagcctcccaaagtgctgggattacaggcgtgagccactgcacccagccggctttgtttacagtactcagcagctgccaaaatagtccccattcccaggcagggcaggctcccgggctcagtccagcggggcagatggccagcctgcacgtcaccccactaggcatgtccaggccctttctgcccctccctaaaggcacccctgtcctttctgtcccctccacactgagccaagccagcctccactcttgccccaggcctgccctctgctgggagccgggacactgagctcctgccacatgagcaggttgacctgcagggggcctccaagcaggtgccaaggcagaatcggatgtgaccaggagaacacccttgaaggataaagcgaatgtgcgaccaccatgcaggtctggcccatggaagggaggggagggggccccgacggggccacagtaaaggagtggaggggccccacaggcagggatggcccagctggccccctggggctgtgaatctgcaggtgcagtgcagcctcttgcctctctcagcccagcccttgcatctgcctcttggtgtgtctgtgaagacaaagtcaccgtggtccctgcagcacctggcttgaagcaggtgtgcagtccgtgtgaaagccttccctttagctattaggtattgagtcaaaaaaaaaaaaagccttcccctgagcctgggggcctggccccactgaggataccaggcgggggaggctacaggaggctgccctctgcctggccatctgaccttccattctgaccccttcccttccacaccagcccctttccctatgtagggtgcagtctttgttgcaactgctcacctctgccatggtcggatgagagcagccacggacaatgtctgtgcaattgtgcgttttttgttttgttttgttttgagatggagtcccactcttgttgcccaggctggagtgtaatggcaccatctcggctcactgcaacctccacctcccgagttctagcgattctcctgcctcagcctcccaagtagctgggattacaggcatgcatcaccatgtctggctaattgtgtatttttaatagagactggggtttcaccatgttggtcaggctgttcttgaactcctgacctcaggtgatccacccgcctcagcctcccaaaatgctgggattacagacgtgagccaccgtgcctggttgattgtgcgttctgataaagcttcatttacagaaatagcaggtaggcccctcgcagggtgcccagagcaggtgcactgtctcacctcttctcaggtgtcaccggggtgagaggctagtcctctgcctcctccttcctctctgcaggttggagaaatgacagcttcttgtactgggggttatgagacagtggcaggagggggacactcccagagtgctgccagaaagaggcgaggccccatctggatttgatggcatttttattgtggtgttgttttagagacagtgtctgtcgcccaggatggacgacatggtgcaatcatggctcactccagcctccaactcctgggcccaagcaatcctcccacttcagcctcctgagtagctgcagctataggcacaccaccatgcctggctcaatgggtattttgtggccattaaacttctggtcattcctttagattcccagaggctggatggaggtgagtggccagcccctgggtccagagatgagcgcggggcctggctgcagcctgtggggtctcccaggctggcctccaggtgtcctctcagcctgtccacaggcgctgcccaagcgtgtggcctacctggtgctgcctggcctgtctctacgcacctgtactggctctccctggattactggatcgcagtcgaatcccctgccagaatcctggtccccctttatcacaccggatcagccccaaagggcagggcttcttgcagcagttccagcctttgctgggggtttccagccctgttgagcaagccccaggtagggccctctgcagcccccgtgggggacctgtgtgccgagcagagctgccccgtgtgtaaacgcttagaactggcctccttcctgccatctgtgtcctgtttgtcatcacgcctgtggctctatgcttgtctccccgactgggccaccagccctgtgagggcaggatgaggcacgtccaagccacagtggctctcagtgtgcagggtgctgttagcattggttctgtgttctggaatagtgagaacagtgtgccccaaatggccagtggcctttccgagggtcactgcagccgcatgttggccctctgtggagaacggaggatgcacagccatttcagagcacaacctgaggtctcctgagcttgctgtgcagcccagtctttctctccgtggcccctggtagctgtctttctcccaggaggaggagaaagacaccttcctgagcaggaggatgtgggtgaatagagaccaaagtgtcaatcactcttctgacagaggtgatagcagaatgaaaaactgatggaccccagatctttgcaaagagaacaaagtcagtttctagttatctttctttcttttttttctttttttctttttttttttttttttttttttttgagatggagtctcgctctgctgcccaggctggagtgcagtggtgtgatctcagctcactgcaaccgcctcccgggttcaagtgattctcctgcctcagcctcctgagtaaccaggactacaggcacacaccaccacgcccagctaatttttgttatttttagcagagacagggtttcaccatgttggccaggatggtcttgagctctcttttttttttttttttttttttttgagacggagtctcgctctgtcacccaggctggagtgcaatggagtgatcttagctccctgcaacctctgcctcccaggttcaggctattctcctgcctcagcctcctgagtagctgggactaacaggtgcttgccaccaagcctggctaatttttgtatttttagtagagacagggtttcaccatattggccaggctgatctcgaaatcctgaccttgtggtctgcccgccttggcctcccaaagtgctgggattacaggcgtaagccaccacaccaggcccattttctagttatcttttacggattttttaaaatgagcctagaaaccaggtcatataattagtttattttttaatttcttatagagacagggtcttactatgttgcccagagtggtcctgaacgcctgggctcaagtgatcctcctgcctcagcctcccaaagtattgggattacaggtgtggccactgttccagccatagttcatattttaaaggatttttaagagtctcatttcactgatgttacttgcagtatatttatggaaaacattcctgtcttttttttttttttgagacggagtctcactctgttacccaggctggagtgcagtggcgtgatctcggctcactgcaagctccgcctctggggttcacgccattctcctgcctcagcctcccgagtagctgggactacaggtgcctgccaccacacccggccaattttttgtatttttagtagagacagggtttcactgtgttagccaggatggtctcgatctcctgacctcgtgatctgcccgccccggcctcccaaagtgctgggattacaggcatgagccaccgcgcccggccagcattcctgtcttttaaagaaagatgagaccagatgcagtggtgtgcacctgtggtcccagctactcaggaggatgccttgagcctgggagttcaaggctgcagctgcagtgagccttgatcacgccactgcactccagcctgggcaattgaacaggaccctgtctctaaagaaataaaataaaggcagatgaatgtcatctagggtgtgtccaatgtgagagagaatactgaccaggtgacagaggtgatggactctctagctctgcagcagactgctgggcagagaagcttgggcaggcctggcactgaggcccagaagcttcatgctctttagagccagaggtgtcaagcccagctgcctgtgtcctggccgcactgtgaggcactgaggatgccctcacacgtgcatctgcatgtggcgtgcatgtggcaagcatgtgcaggtgctgtgtgggcacgatcatgcctgccctctactgtgctggagaggtaagaccatcagccgtttcacagaggagggaatgtggacctcacgggggtctcatgagcttgcgagccgatggccaggcagccggtgcagaaggttcatccattttgatgaaccgtgaattcatctgtactttattcattttaataactgaatcatacctcattgtatggctctaccatgttttattatccattcaggtgctaacggatggaagggttgtttctacctgttggccattgtggatgatgttgctatgcatattggggtacgagtatctggtttagtccctgttttcaattcttggtatacacctaggagtagaattgctgggtcatatggtagttctattttaacttttttttatttttaatttttgtgggtttttaagaattttttaatatttgtgggtgcatagcatgtttaattttttttttttttttgagacggggtcttgctctgttgcccaggctggagtgcagtggcaggatcacagccctgtgcagcctcaacctcctgggctcaggtgatcctcccgcctcagcctcccaagtatctgggactacacgtgcggaccaccacgcctggctaatttttaagttttttgtagagatggggtcttgccatgtttcccagactggtatgggactcctgggctcaagcaatcctcccatcccaacctcccaaagtgctggaattacagtcatgagccaccaggtctgaccacatgtttaactttttgaagaactaccaaactgttttccacggcattcacaccagcaatgcaagagggttcccatttcatcacatccttgctaacacttgttattttccttaaaaaaaaaaaaaaaaaaaagccagctgggcacggtggctcatgcatgtaatcccagcactttggaaggccaagggggtggagcacttgagctcaggagactagcctgggcaaaatatcgagaccccacctccactccatctctaccaaaaaaaaaaaaaaaaaaaagctgggtgtgcggtggtgcacatctgtcgtcccagctacttgggggggctgaggcaggaggatcccttgagcccaggaggtcgagactgcagtgagctgcgaccgcgccactgcactccaggctgagcgacagagtgagaccctgtttcaaaaaaacaaaaaaaaagcacatttcaaacatacacaaaagcagagagaattcccctcggtcctccggcctgcaccccaccgccccccaccacaggggcattcaaaactgtctttttgcctctctgtaaggtaaggggggactcttgacgctccccagaccacacagccaaagtagggcgatcggatcatagggggtcccgagtcggacactgagctggcgtgcccactctcgagtcctgggaccccaaactaaaggagctgttccttttccccatggagggctgacggggcaaaatcccagggctgggaacatccgagcagctttgagtagcacaggtgggtttctacgtggctttctttaaagggaggcctgattctcggcttttcaggacccgccctccattttctcacttgcctgctctttcgtcctgcgaaactgggcagtggccggtgacagcgcagggtcagccctcggatggccaggtgggcgtgatcccaccctcctccgtggctgggtgggcgtggtcccaaagtcaattggatgtggtcccgcgtccctcccggcccagtgggcggggcctccccttctggggcctcccatcccacaccagcgagcagagaggagggtgggcggggaggccctacggggctggggcggggcggagcggaggtggttagctgtcgggaggtggggtgggcaggggccagggctctgttggtggcccggggcagccagtccctctgctcagggcttcagttcacactcacaagggaatcccagcgctcttctcctctggcggttgctggagggccttgtgaggtggccgtgggcactgtagcccccaggcactgcattgtggcctgggcgtgttggcctttgagcctttggccttgagcacttccccatcccccatggctcttggccgttggggcccagttggccgcagagcctttggccttgagcacttccccagcccccatggctcttggccattggaccccagttggccacagagccgcgggcaggtgggacaggcgggcactgggtgcctccttgcaccagccaggcccagcctgcagagtggagtgggccggtccctcctgccaggcaaaggaagggggcttcgggcccctccctgctgtggcctcctcccctctgctgcctcccactaggccctgggagacactgcctgcagatttatgaacagacagacctagagattagagattcaaaagccaaattcttacacaattcaagtattaacgcagatttggatttataatttgggactccaaggtctaccaagtaatttgctgtttcagaatagcccttttaatttggggtatatatttctaacactgttttttaaatatggagagtaaacaaaatggcccattatctgaccacacaaatactagtagtcattatagataaaccatagcagataaataatagtaaacaaagcaacaggctgtgtcataggaaatccccaccatgaagaaaggagcaaggtggaaagttctggctgcttcaggtctgcatggtccctctccaccatggttccccctgtcatcttcctgccagaataaggacactgtccttagggaagcaccatctcttgttttttccccacgagccctgtgggtcatggcacgtcctgccccgctgggaaacacagtgggccacgggtttccctgcaggcctgggacccttcccaagggtagcagcagaaggcagcacgattcccactcctgcagctgtggacaggggcacccccactgtcactgagccctgcaccgggttccatcacctgctcggggctctggcctttggccttttcctgtgagctgcatgttggccactgtgacctatctgtctcatcatctttttcttactggtttgtgtatgttcttggtaaactagcccttggtcttacacatcatttccaaggtactaaggactcttcaggggaaatacaacttgagcagagtggttccctcctcttgtggttcacaaggtgcaggtgcacacacacatagcccacagggcagtgtggacagggaccaggagactgcccctggggtccctggctgggggacactagtagggatgtcccttggcctctctgaggccttctgctgtctcttctgaggccggaaaggcgaagcactgccctcgccctgctagggaaggctcaggccaggctggccctatccggggaaggggctcaggtatctggaccttggtcatcgccaggttagggtttatgttgatgattatccaaaggcaaaattgatttccacagaaataacatctgctttgctgccgagctcagaggagaccccagacccctcccgcagccagagggctggagcctgctcagaggtgctttgaaggtgagttggccaacggaagccggggcagtgccagggtgggtacagattccggcccggtgcatgggcacaggtctgctgagcacatgtccactctgcctgtgtaaataggccacatggcctgaaatcccctagaagcctggtgtccgcatgacctccccctagggcggagcctctgcttccctgttctcttctgctctgtcctctggtgccctgaggctggcctccaggggtgtcccctctgtggccctaggcctgcctccttgcctgggtgtgcctttctaaaatggagcgtccagcagagagtgggatctcctatgccactgggagcccagggccccatcccagaaagacctctgagtgagcacaggggccctagaagaagtttccttgtgtccttcccgttttagggtctgtgacctgaacccctgggcttctgcctcaggcctcctgtgctctgctctctgcctgctgggtcccctcaccaggcttctgtctggttcccaggctacctgcctggagggtcacaccaggaggatttcaaacaggtttcaagtggggtcacttgccatcactgtgccccacgaggtacactgttgtgggcggcagggctggcctttctcatctgggacatgccacgttgctgttcccaaggggagtggtgagtgggtctgtcctggtgtgcctggcctggggactgccagtgtccttacttggacactcaatgaaaaggccacatgaatccctggggcgtccagagcatgggtgaccagcacgggctcaccacatgaggccaaggggctgcaccatacagcctctcctttggccacccgtgactacccccaactccgggccatggggcttccctacccctgggtgtcctctaagccagctgggagacaacagcctgagtccgtgtctgcttctgtattttgtgtggttttagaggatccctgggctgcctggggaagcacccagggccagggagtgtgaccctgcaggctccacacaggactgccagaggcacacacctgctctgtctacccgagggcaccagagggcacgagaaggctggctccctggcgctgacacgtcaggcaactgaggcacaaggctggcatttctgaaccttgcccctctgcaaacacaagggggcgatggtggcactccaagcaaaggggcgtgtgggtgctgcaggaggagcacagagcactggcgcccctcccctcccgccctgcagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggtggggtccgggccagcaggtgctcagctctgggacagggacccaggaccaggcatcaaagcccttacaggagaagctgttatcaccccatttccagggggctgggaaccctgggatatgcccagatagggctggggggctcctctggagtcccagggtgccagggtccctgatgacccctgcaggccctgctgcctgctgccccaggacaacaggcccccacactcacagggtctgacggtggtgcagttccccttgaactctgttctggccaccatgggacctgcctggggaccagtcagacaggttctcctgggcccgcctcccgcttgaacttcagcctggggcacaggatgtgttaccgggctcacggagtgactcagggaactagtgccgccccagggccccaaggtgggcggttcggtgattcagagagggcagctctgtgttaggacacactggggccagccaggaagggtggaaaagatagggaccagcgtgagcatagaggctaagggaccatgggagctccaagcgcgctcacagtggggaccaggtcctgggggctggggacaccagggaggtgaaatacccctccagcgggtagggagggtgggcagaggagggccagcggccaggcatttgggaggggctcctgctctttgggagaggtggggggccgtgcctggggatccaagttcccctctctccacctgtgctcacctctcctccgtccccaaccctgcacaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtgtgcatgcctgacccgttgtcagacctggaaaaagggccggctgtgggcagggagggcatgcgcactttgtcctccccaccaggtgttcacaccacgttcactgaaaacccactatcaccaggcccctcagtgcttcccagcctggggctgaggaaagacccccccagcagctcagtgagggtctcacagctctgggtaaactgccaaggtggcaccaggaggggcagggacagagtggggccttgtcatcccagaaccctaaagaaaactgatgaatgcttgtatgggtgtgtaaagatggcctcctgtctgtgtgggcgtgggcactgacaggcgctgttgtataggtgtgtagggatggcctcctgtctgtgaggacgtgggcactgacaggcgctgttccaggtcacccttgtggttggagcgtcccaggacatcatcccccagctgaagaagaagtatgatgtggacacactggacatggtcttcctcgaccactggaaggaccggtacctgccggacacgcttctcttggaggtgagccccaaccaggatggcatccgtgccagctgctgcccagagcccattcagtcagcctcagcctctccaaagagccaggcattccagtagagccctgtgtggacacagctcgctctggaggcaccacctgaggtctgggagtgtgggggactgaggaggccctgtggtgggtggagatgggtggggagctgggccaggggcctggctgggtggcctgttgggaactggggagccagctgcctgtgcaggtgcaaaatgggtggcagaagtggggtgcacaccccagaccagacaccagggcagaaacggcacaggaccaaggagatggggtggggaagggccgctctgggcccagcctgctctcccccaagcaagccactgctcgtgcaaagaaagcatgtgtctcctgcagatcttcctcctgaggccccatcttgtgcattcccccaacccagccccactggcgaggaccctgagtgccccgagtgaggctagacagcgggtggggctgtcctcgcttccctggggggcgtggggcactggtggcccttcacagactgatgcttaaggagcctcacatcagtgacacactgccccatccctccctggtggtcagcgacactgagtggctctgtgatcctccactgggcttgggacacccaccctcacggcctccccacctggtgctcgctcacctgcagctctcccagaaactggacactgctgttagcagccggactaggagcacgaggggcacagcccccatgcctggctaggtagggccgctggaccctggacacggattggaaggaaccagcactagcagaagcctgaggtgtgaaagggcagagaatgttccaggaacaatgggagtcagggcacacaggactttgggcaggtgaggatgaggttagacctgtcttctggagctgggctcaggggctcatgcctgtaacccttgcactttgggaggctacggcaggaggagcgcttgaggccaggagagttcgagaccagcctgggcaacatggcaaaagaaaaaatatatatatatattttagatggagtcttgctctgtcaccaggctggagtgcagtggcacgatcacggctcactgcaacctccacctcttgggttcaagcgattaccctgccttagcctcctgagtagctgggactacaggcgcgcgctgccacacccggctagttttttgtagtttagtagagatggggtttcaccacattggccaggatggtctcaatatcctgacttcgtgatccgcccgcctcggcctcccaaagtgctgggattacaggcgtgagccactgcgtccggccgtattccagctttcaaaacaacaaaaaacaacaaaaacttttctggaaagatccctgtcagccttgtggagtgtggagagggctgtggggagggcatttcagatgccctgaactcacgaggaggcactgaaccctggccgtggagagggaggacctgtagtggccaagggggtgggcattgggagggtgggagggagacctacaggccaagacagggtagctggaggggggctcacccctgacaaaggagcatgatgctggcaattgggtattgatggcagagagctggcactcagccagatgggcttcacttgggcaggaaagacacccacagctgggcctgcgttactgcggccgagtttcagcagctgtgatgtgggtgctaattacaggggcctgccttcatagaaaagtagcaaacattgcagtttagtaactaggaaactaatagttttctcagtgctgcttgcgcaaagctggtaattatctcaaaagaagcaaagtcatgaagtgggaagtcatgaattgggaatgggtgtccttgttaaacgcacatctgcacactcagggctggggccctgtgcccccttgtggagggttaggggacaacctggctcttgtgagggtctagccatcccctcagtgggttctgtgagcatcggaggcacgaggggtgaggggctcaggagcaggttgcaattcaaaatcaagggctgctttgaggaggcctctccaccgggctgctgtagtcaccaagtccagcccatgcccaaaggaagaggaatgagttcccccttaaaaaaaaaaaaaaaaaaagaaaaagacagagtcttgctctgtgcccaggctggagtgcagtgatgacatcatagctcactgtagcctcaaactcctgagctccagtgatcctcccacctcagcctcctgagtagctaggactaaaggcatgcaccactacacctggctaatttaaaaattttttgtagaaatggggtctccctatgttgcccagactggtctcaaactcctggcctcaagcgatcctcttgcctcaacctcccaaagtgctgggagtacaggtgtgtgcttggtctgaggctccaactttttgttgttgtttctcgagacagtctctcgctctgtcgcccaggctggagtgcagtggcgcgatcttggctccctgcaacctctgtgaggctccaactcttgaagggaggagagtctaaggagggtgggccagatgaaaaccacctcagcatagtgtcacctgctcctctgacactgtcgcttctccacggcattagattttcagtcctgctcagacgctgatgcatgtttagccagttctccaggtggtctgagtagctggtaggaggcttgcagtgtcgggcgacaggcaggacaggtgctgccttctttcccctcttgaccagtttcgtaaaggagtgggcccctggcagcctccaaaggtgacccatgctcctttctgcccttccctccttctttcctgtttaactcgtgcaggtgcagtggtctggtgtctttcagtccgctgacgtcttctgtatccctgatgaccagattgggctcctgagtcccctggcgcaacccgagaagtccaggagcccaggcccctcactcatgcattccctggcccagactggaaggcagccgccctgctcaaggcctaggccattgtcctcctcccgggtggcgctttgttctacgtcttttcagctgacattgctaggacatttttttttttttctaaatgaaaacacatcatgattcatggtggtacttcctgctcaactccggaccttggggctgtcccctgacctcactgaccttgcagccgtgtggtgtccatactgtcacatgaaagccccctgctttctctgcagcatacaggctggaaacgaccgccacccaccaccaggacagctgcaagccctgtgggactctccaggcccatcccagaggcatgtggggtcggataccagtgtttcaaggcacctgcctgcaaattgattttattatactttagatgtttgagattgcttgttaacttttgtttggtgactaagtcaaatttccaagacaaggtgactggggtgtcccttgccctggtaggtccttcctccccataggcaaacacttcctctcaaggtttcttgtttatgtgatgtaagcaaacccttttctgatagcatagataggcaagcatcctatgaggtttctcccgatagtggaccccacgggccatgccctatggctgcgtgtccagtaacaactccttccttctgcacagaacccaggcagaggaactctgtgtcctcccagggcccaggcactggtgaagatggggggtctgcaaatgcaggagcttggggatgtccagaactgaccccaaggggcaggcttgttgatgggaggtctgccccacctcagccctgcagggtcaccctggtcaggccaatattgtctccagggaccataccagcaacccctctccttgggtgcctctccctcataggcctgagttcctggcactgggtgttgagggccccattgtttccactcacccagctagcatttattgagcacctactgtgtgccacatgctgttctaagggatggatactcctgagatggatacaggagttgatgagagaaaggtccctgtcctcacggggcccatgttctgaaggtggcacccaagtcttgtacagtcctttcctgcaggagtcacgctgggcagaaagtggaaacctggccccaggggctaggcacaggcgtggtgccgtggcctagtgaggagcacccatcctggtttggggcaggttctctgggcacctctgaccctcacctcccccaccccccggtctgtttgcaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataactcgacttagtacatccttctcaactgccattcccctgctgcccttgacttgggcaccaaacattcaaagctccccttgacggacgctaacgctaagggcggggcccctagctggctgggttctgggtggcacgcctggcccactggcctcccagccacagtggtgcagaggtcagccctcctgcagctaggccaggggcacctgttagccccatggggacgactgccggcctgggaaacgaagaggagtcagccagcattcacacctttctgaccaagcaggcgctggggacaggtggaccccgcagcagcaccagcccctctgggccccatgtggcacagagtggaagcatctccttccctactccccactgggccttgcttacagaagaggcaatggctcagaccagctcccgcatccctgtagttgcctccctggcccatgagtgaggatgcagtgctggtttctgcccacctacacctagagctgtccccatctcctccaaggggtcagactgctagccacctcagaggctccaagggcccagttcccaggcccaggacaggaatcaaccctgtgctagctgagttcacctgcaccgagaccagcccctagccaagattctactcctgggctcaaggcctggctagcccccagccagcccactcctatggatagacagaccagtgagcccaagtggacaagtttggggccacccagggaccagaaacagagcctctgcaggacacagcagatgggcacctgggaccacctccacccagggccctgccccagacgcgcagaggcccgacacaagggagaagccagccacttgtgccagacctgagtggcagaaagcaaaaagttcctttgctgctttaatttttaaattttcttacaaaaatttaggtgtttaccaatagtcttattttggcttatttttaa

SEQ ID NO: 1039 - DNA, 7429 bp, Homo sapiens
gctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggtggggtccgggccagcaggtgctcagctctgggacagggacccaggaccaggcatcaaagcccttacaggagaagctgttatcaccccatttccagggggctgggaaccctgggatatgcccagatagggctggggggctcctctggagtcccagggtgccagggtccctgatgacccctgcaggccctgctgcctgctgccccaggacaacaggcccccacactcacagggtctgacggtggtgcagttccccttgaactctgttctggccaccatgggacctgcctggggaccagtcagacaggttctcctgggcccgcctcccgcttgaacttcagcctggggcacaggatgtgttaccgggctcacggagtgactcagggaactagtgccgccccagggccccaaggtgggcggttcggtgattcagagagggcagctctgtgttaggacacactggggccagccaggaagggtggaaaagatagggaccagcgtgagcatagaggctaagggaccatgggagctccaagcgcgctcacagtggggaccaggtcctgggggctggggacaccagggaggtgaaatacccctccagcgggtagggagggtgggcagaggagggccagcggccaggcatttgggaggggctcctgctctttgggagaggtggggggccgtgcctggggatccaagttcccctctctccacctgtgctcacctctcctccgtccccaaccctgcacaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtgtgcatgcctgacccgttgtcagacctggaaaaagggccggctgtgggcagggagggcatgcgcactttgtcctccccaccaggtgttcacaccacgttcactgaaaacccactatcaccaggcccctcagtgcttcccagcctggggctgaggaaagacccccccagcagctcagtgagggtctcacagctctgggtaaactgccaaggtggcaccaggaggggcagggacagagtggggccttgtcatcccagaaccctaaagaaaactgatgaatgcttgtatgggtgtgtaaagatggcctcctgtctgtgtgggcgtgggcactgacaggcgctgttgtataggtgtgtagggatggcctcctgtctgtgaggacgtgggcactgacaggcgctgttccaggtcacccttgtggttggagcgtcccaggacatcatcccccagctgaagaagaagtatgatgtggacacactggacatggtcttcctcgaccactggaaggaccggtacctgccggacacgcttctcttggaggtgagccccaaccaggatggcatccgtgccagctgctgcccagagcccattcagtcagcctcagcctctccaaagagccaggcattccagtagagccctgtgtggacacagctcgctctggaggcaccacctgaggtctgggagtgtgggggactgaggaggccctgtggtgggtggagatgggtggggagctgggccaggggcctggctgggtggcctgttgggaactggggagccagctgcctgtgcaggtgcaaaatgggtggcagaagtggggtgcacaccccagaccagacaccagggcagaaacggcacaggaccaaggagatggggtggggaagggccgctctgggcccagcctgctctcccccaagcaagccactgctcgtgcaaagaaagcatgtgtctcctgcagatcttcctcctgaggccccatcttgtgcattcccccaacccagccccactggcgaggaccctgagtgccccgagtgaggctagacagcgggtggggctgtcctcgcttccctggggggcgtggggcactggtggcccttcacagactgatgcttaaggagcctcacatcagtgacacactgccccatccctccctggtggtcagcgacactgagtggctctgtgatcctccactgggcttgggacacccaccctcacggcctccccacctggtgctcgctcacctgcagctctcccagaaactggacactgctgttagcagccggactaggagcacgaggggcacagcccccatgcctggctaggtagggccgctggaccctggacacggattggaaggaaccagcactagcagaagcctgaggtgtgaaagggcagagaatgttccaggaacaatgggagtcagggcacacaggactttgggcaggtgaggatgaggttagacctgtcttctggagctgggctcaggggctcatgcctgtaacccttgcactttgggaggctacggcaggaggagcgcttgaggccaggagagttcgagaccagcctgggcaacatggcaaaagaaaaaatatatatatatattttagatggagtcttgctctgtcaccaggctggagtgcagtggcacgatcacggctcactgcaacctccacctcttgggttcaagcgattaccctgccttagcctcctgagtagctgggactacaggcgcgcgctgccacacccggctagttttttgtagtttagtagagatggggtttcaccacattggccaggatggtctcaatatcctgacttcgtgatccgcccgcctcggcctcccaaagtgctgggattacaggcgtgagccactgcgtccggccgtattccagctttcaaaacaacaaaaaacaacaaaaacttttctggaaagatccctgtcagccttgtggagtgtggagagggctgtggggagggcatttcagatgccctgaactcacgaggaggcactgaaccctggccgtggagagggaggacctgtagtggccaagggggtgggcattgggagggtgggagggagacctacaggccaagacagggtagctggaggggggctcacccctgacaaaggagcatgatgctggcaattgggtattgatggcagagagctggcactcagccagatgggcttcacttgggcaggaaagacacccacagctgggcctgcgttactgcggccgagtttcagcagctgtgatgtgggtgctaattacaggggcctgccttcatagaaaagtagcaaacattgcagtttagtaactaggaaactaatagttttctcagtgctgcttgcgcaaagctggtaattatctcaaaagaagcaaagtcatgaagtgggaagtcatgaattgggaatgggtgtccttgttaaacgcacatctgcacactcagggctggggccctgtgcccccttgtggagggttaggggacaacctggctcttgtgagggtctagccatcccctcagtgggttctgtgagcatcggaggcacgaggggtgaggggctcaggagcaggttgcaattcaaaatcaagggctgctttgaggaggcctctccaccgggctgctgtagtcaccaagtccagcccatgcccaaaggaagaggaatgagttcccccttaaaaaaaaaaaaaaaaaaagaaaaagacagagtcttgctctgtgcccaggctggagtgcagtgatgacatcatagctcactgtagcctcaaactcctgagctccagtgatcctcccacctcagcctcctgagtagctaggactaaaggcatgcaccactacacctggctaatttaaaaattttttgtagaaatggggtctccctatgttgcccagactggtctcaaactcctggcctcaagcgatcctcttgcctcaacctcccaaagtgctgggagtacaggtgtgtgcttggtctgaggctccaactttttgttgttgtttctcgagacagtctctcgctctgtcgcccaggctggagtgcagtggcgcgatcttggctccctgcaacctctgtgaggctccaactcttgaagggaggagagtctaaggagggtgggccagatgaaaaccacctcagcatagtgtcacctgctcctctgacactgtcgcttctccacggcattagattttcagtcctgctcagacgctgatgcatgtttagccagttctccaggtggtctgagtagctggtaggaggcttgcagtgtcgggcgacaggcaggacaggtgctgccttctttcccctcttgaccagtttcgtaaaggagtgggcccctggcagcctccaaaggtgacccatgctcctttctgcccttccctccttctttcctgtttaactcgtgcaggtgcagtggtctggtgtctttcagtccgctgacgtcttctgtatccctgatgaccagattgggctcctgagtcccctggcgcaacccgagaagtccaggagcccaggcccctcactcatgcattccctggcccagactggaaggcagccgccctgctcaaggcctaggccattgtcctcctcccgggtggcgctttgttctacgtcttttcagctgacattgctaggacatttttttttttttctaaatgaaaacacatcatgattcatggtggtacttcctgctcaactccggaccttggggctgtcccctgacctcactgaccttgcagccgtgtggtgtccatactgtcacatgaaagccccctgctttctctgcagcatacaggctggaaacgaccgccacccaccaccaggacagctgcaagccctgtgggactctccaggcccatcccagaggcatgtggggtcggataccagtgtttcaaggcacctgcctgcaaattgattttattatactttagatgtttgagattgcttgttaacttttgtttggtgactaagtcaaatttccaagacaaggtgactggggtgtcccttgccctggtaggtccttcctccccataggcaaacacttcctctcaaggtttcttgtttatgtgatgtaagcaaacccttttctgatagcatagataggcaagcatcctatgaggtttctcccgatagtggaccccacgggccatgccctatggctgcgtgtccagtaacaactccttccttctgcacagaacccaggcagaggaactctgtgtcctcccagggcccaggcactggtgaagatggggggtctgcaaatgcaggagcttggggatgtccagaactgaccccaaggggcaggcttgttgatgggaggtctgccccacctcagccctgcagggtcaccctggtcaggccaatattgtctccagggaccataccagcaacccctctccttgggtgcctctccctcataggcctgagttcctggcactgggtgttgagggccccattgtttccactcacccagctagcatttattgagcacctactgtgtgccacatgctgttctaagggatggatactcctgagatggatacaggagttgatgagagaaaggtccctgtcctcacggggcccatgttctgaaggtggcacccaagtcttgtacagtcctttcctgcaggagtcacgctgggcagaaagtggaaacctggccccaggggctaggcacaggcgtggtgccgtggcctagtgaggagcacccatcctggtttggggcaggttctctgggcacctctgaccctcacctcccccaccccccggtctgtttgcaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataactcgacttagtacatccttctcaactgccattcccctgctgcccttgacttgggcaccaaacattcaaagctccccttgacggacgctaacgctaagggcggggcccctagctggctgggttctgggtggcacgcctggcccactggcctcccagccacagtggtgcagaggtcagccctcctgcagctaggccaggggcacctgttagccccatggggacgactgccggcctgggaaacgaagaggagtcagccagcattcacacctttctgaccaagcaggcgctggggacaggtggaccccgcagcagcaccagcccctctgggccccatgtggcacagagtggaagcatctccttccctactccccactgggccttgcttacagaagaggcaatggctcagaccagctcccgcatccctgtagttgcctccctggcccatgagtgaggatgcagtgctggtttctgcccacctacacctagagctgtccccatctcctccaaggggtcagactgctagccacctcagaggctccaagggcccagttcccaggcccaggacaggaatcaaccctgtgctagctgagttcacctgcaccgagaccagcccctagccaagattctactcctgggctcaaggcctggctagcccccagccagcccactcctatggatagacagaccagtgagcccaagtggacaagtttggggccacccagggaccagaaacagagcctctgcaggacacagcagatgggcacctgggaccacctccacccagggccctgccccagacgcgcagaggcccgacacaagggagaagccagccacttgtgccagacctgagtggcagaaagcaaaaagttcctttgctgctttaatttttaaattttcttacaaaaatttaggtgtttaccaatagtcttattttggcttatttttaa

SEQ ID NO: 1040 - DNA, 36324 bp, Homo sapiens
cggagggggaggtggctgccgcttctcccgcgtccgccattttgttgctgtggctattgggaacaagctgggcaaaagcaccccggaggcgcgacgctccttcgagttcggtgcctcgtgtgacggcgggggtcggtgaagacccgtcgagctgcggcgccggcgcgttccaggccgggagtcactggaggcacccctgggacgccgagcagcccgagaaccccggggtggcctccgctgcggctcgggtttgcctgccccgaccccccggctctgccgtgcattcccgggcggctctctccgtgtggcggccccggagcaggcgggcggcgtcggaggatgctgcgggcccggagccgagaggaaagtgctggcccagccctctgagcgctcctcgaggtgtgcgagaggcccttcctcggccccaaagccgtctgccgggctaaggcgtgcagagcaggcgaggacagccgccgcccctaccgccgcagagtccccggtccaacaccatgtcctccgccaggttcgactcctcggaccgctccgcctggtatatggggccggtgtctcgccaggaggcgcagacccggctccagggccagcgccacggtatgttcctcgtccgcgattcttccacctgccctggggactatgtgctgtcggtgtccgagaactcgcgggtctcccactacatcatcaactcgctgcccaaccgccgttttaagatcggggaccaggaatttgaccatttgccggccctgctggagttttacaagatccactacctggacaccaccaccctcatcgagcctgcgcccaggtacgcgagagccctccccgaccgcggaggaaggtcgagaaccgggtctgtcgaagagtgcttgtataggggggtggggcgcgcttgaacccatattccccgcattctgaaccaaattattttccagaaggccttcctaacagaaagctagtgtcaggatctgggtcactggataagaggatgcgttttttttttttccctctcacgaggctgtttctcaatgtgaagaggatgcgttttgaatgtttaacggtggttgcatagttaaaatgcacgctttttgcctttcgtgactttctctgggtgtaatactgatgcagggatttgttggtttttctaaaaacctcttttttttttttttttttgagacggagtctcgctgtgtcgccaggctggagtgcagtggtgcgatctcggctcactgcaacctccgcctcccgggttcaagcgattctcctgccttagcctcccgagtagctgggactactggctcacgccaccacacccagctaatttttgtatttttagtagagacggtgtttcaccatgttggcctggatggtctcgatctcttgccctcgtgatccgcctgcctcggtctcccaaaatgctgggattacaggcgtgagccaccacacccggccaaaaaccgtttttaagccatagacttctttgagaatctgaagatagccgagcactcaccaccccacccccacccccacccccacccctccccgccaaaggcacgtacacacaagtttgcacaccatcccgggtgcttgtactccctccagatctctgaactccaggttaagaactccaggactgcagcctttggaacagtcaaaaaaatgaaaatgctttagcgtttagaaacaaaaaaacctttaaccaaaatatcagaactgtatattgatactgtggtgccaagtttgaagcaggccagacaccaccacttttatagtacgttaattacaaagataagagaaggtgcattggcttcagcgaggatattttttggaaaatttattgcatattttctccccgaggaccattagtaggccagagatcagtctggttaatttccaaggtggaattaggctagaatgttattaaggaaaatttttgaatgacacttagttgtatcctagttcaatttcagacatgctttttgtgttaagtctaatgattttgtatttcttattttaaaattaacgcaaagtgaccaagcattctcttttccaagtgaaatacgttattttaattgattagttgctttaatttgccttaagcgttttagcagagatttgcttttattgttgtgtttgccctgtaacactgattttatcagaggtttcttttatttaaattatcccaaatttgagttgaaaagttgcctagaatttttaaagtaacaaactggccagttcgtttcttaaacatctattttaaaaggactgggtgttgatacagtttttccagggttagatgtttatgactttatggatttgtcgaccgggtattactctaaactttaaacattaaaagctattataattgaggacaccaactgtttgcatagtgggatagagatagaaaaaaaaaagccatgacagtataatgactacaagattaactactgaactaaatggactttaaaagtggggagaaagtgattataaatcaaatactgtataacaaagaccaggacaccaagaatctgattggtgaaacctgcggttcctggcagatgctggtagttgcagtcaactttgagcacaatataattccaatttaaggagttgagaatcttagaacccactgtagtgagatttgtaatatgactgaataaattcttcctctcgtttgtgagcgtgaattatataattaataccaggcattcattaagccatgcatatgcttatgttgaggtcatgagtactaataatacagctgtttcaaaaagcaagttaatgggcgggtgtggtagctcacgccagtaatcccagcactttgggaagccaagccgggcgaatcacgaggtcaggagttcaagaccatcttggccaacatggtgaaaccccgtctctgctaaaaatacaaaaaattagctgggcgtagtggtgggtgcctgtaatcccagctactcgggaggctgaggcaggagaatcgctcgaacccgggaggcggaggttgcagtgagccgagatcgcgccactgcacagcccgggtgacagagtgagactctgtctcaaaaaaaaaaaaggaaaaagttaatgacttgagtctccttctagaggaaggaaaagaagtatgccgcttctctctatccacagaatcgcctccagattttccgtacatgcatgcatcttcttagagaacaagcatgtaattctgtctttgccctctttcgtccttcctttactgcagctgtactaggctgctcacttattccctggtagccatccttccttactcatacctttgtacctttgcacctttgctccagctgttggctcttcactgactgccttaactacacctcactctccatctgttgaaatcctacctgttgttccagtcccctcacagattatagggcctttctctgaccctacccctcacgttcagctttgtttctccttctctgtgccctctgcctcaggcctgttgctttaatttagtttttcattttcctaggtatctctgaaggagatcaccatgctggttgaattagatcctgactgagtttactttgttatactgaatcttcgaattgccactcccaagcctggttttcatggcttaggtttaacatgttattagccttttatagaaagctagtgactactagagcctgggccaaacggaaaactcagtgtaatgcttcttcgcatcccaaacagggtacatttagtggcttaactttgcaggcatcaaaactgagcttttaaagccagagtttcatgcctcttggctaatattttggtttatcttgcatagctaaaatttgtaacaataatgtcctactcgaaatttaaggactggtggcttgcattgttatagtcttatccttttcattagaatgcttcataatttttaattttatatttttattcaaatgtttataagagaattataacccagtgtaacccagtgtaggtactgggaaagatgtgtgacagacatactttcttcctgtggaactcctactgtagtggagaagacagactgaaaagtagaaaaataaagtactagtaagatcaatatacaggagggacctacctggggtggcgtggtcagagaaagcatgaagctaagacctgagggtaaagaagaacccagcctaggcaaggcttggcctgagaggaggagaagagccttccaagtttagggaaaagcttatgtagatgtcctgaggtgagaaagtccattgtgttgggagtgtgtttcttttctttctttcttttttctttttttttttcttgagacggagtcttgctctgtcgcccaggctggagtgtgcgatctcggctcactgcaagctccgcctcctgggttcacaccattctcctgcctcagcctcccgagtagctgggactacaggcgcctgcaaccatgccgggcaaattttttgtatttttagtggagacggggtttcaccatgttagccaggatagtctcgatctcctaacctagtgatccgcccgcctcggcctcccaaagtgctggaattacaagtgtgagccactgcgcccggctttttttttttttttttttttttggtagatgacgtctcactctgtggccaggctagagtgcagtggcccaatctcggctcactgcaacctctgcctcccaggttcaagtgattctcctacctcagcctcctgagtagctgggactgcatgggactacaggcacccgccaccatgtccggctaatttttgtatttttagtagagacaaggtttcaccatgttggccaggatggtccctatatcttgacctcatgatccacctgcctcagcctcccaaagtgctgggattacagatgtgagccaccctctccggcctgggagtgtgtttcttaaaggagaaagggggacatataaaatgagtttggagataaagatcagggtcaggaattgggtttttatttaaagtgctgtgggctccaaggaaggaatttgaggcagaggagtgacctggggctgttattgtaatccagctacaaaatgatggtgactaatagtgacagtggagctgtgacttggagatgcctattttggagataaaattgatttgctggtgggtggggatgaagggaaagggaagaagggatgatttggtctatttgtaactttgttatcttctgtgtttttatctttaactgctttttgtatttgtggtattcctatggtggattttattttatttatttttttgagaccaagtctccctctgtcccccaggctgtagtgaagtggcataatctgggctcactgccacctccgcctctggggtttaagattctcctgcctcagcctccctagtagctgggattacaggcatgcactgccacacctggctaatttttgtatttttggtagagacagggtttcaccatgttggccaggctggtcttgaactcttgacctcaagtgatccacctgcctgggcctcccaaagtgctgggattacaggtgtgagccactgcgcctggcctagctctagtgtatttttatttaataagggctgtttccagtttaacaacagaatgcttcagaaggtagcttgctttgtttgacattttccatttctagcttgtgtcgatagataaattcaggctatgaagaaaaattagaataaataaaattttaccattaaaaactaaaggaagttggcccttcaagaaaataatgtactgtactcagcagactttgagcattacatgtacctggtaatatggaaccaacattgaatcagacagccctatcatgcttctgaggagcttactggttactaaaaaaaaaatttttttttttttgagacggagtcttgttctgtcgcccaggctggagtgcagtggcgggatcttggctcactgcaagctccgcctcctgggttcacgccattctcctgcctcagcctcttgagttagctgggactacaggtgcccgccaccatgcccgggtaactttttgtatttttagtagagacggggtttcaccgtgttagccaggatggtctcgatctcctgacctcgtgaaccgcccgcctgggcctcccaaagtgctgggattacagttatgagccaccgcgcctggcatttttttttttttttttgagacagagtcttgctctgttgccaggctggagtgtggtggtgcaatcttggctcactgcaacctccacctcctaggttcaagtgattctcctgcctcagcctcccaagtagctgggactacaggcgcacgcgctaccacacctggctaatttgtgtatttttagtagagatggggtttcaccatgttgagcaggatggttttctgtctcttgacctcaggggatctgctcgcctcggcctcccaaagtgctgggattacaggcgtaagtcaccgcgcctggctactaaaaaaaaaaaaaatgtaaaggttggctgtgctcggtggctcgtgcctgtaatcccagcacttcgggaggttaaggcaggaggatcgctagatcccaggagtttgagaccagccctggcaagatagtgagaccccattcccacaaaaaattaaaaaattagctgagcatggtgtcatgcgcctttaagtcccagctacttgggaggctgaagtggaaagattgcttgagcatgggaggtcgaggctacagtgagctatgatcatgccactgcacttcagcctgggcaacagagccagaccttgtctcaaaaaatgaatgaatgaatgaatgtaagttgtatatatttaatatatttaatctccatgcatggtgaaacagctgtgggagaactgagaaagggtgcttagtctaacctgagagcccagaagaggagcctcacacacctgtgaagtagaagccaatccctgaagggacaggaggaaacaagaagcatggttgtgcctcctctttacatcccctgttctaattatttaagaactcaaatctagacttccataatttggaatggggaaaggattgccagtaattttaatcagcatagaattcaactctgtgaataaacccctttgcgtttctcctgaccagtagttaaaatcatgtgaatttgattcagagaaaaatacaagaacatggccaggtgcagtggctcacgcctgtaatcccagcactttgggaggccaaggtgggtggattgcctgagtgcaggagtttgagaccagcctgggcaacacggtgaaaccctgtctctactaaaatacaaaaaattagctgggcatggcggcgtgtgcctaagaggctaaaggcaggagaatcacttgaacctggggggtggaagttaaagtgagtcgaggtcgtgcagctggactccatcctgggcgacagagtgagactctctccaaaaaaacaaaaaacaagaacactgtcatgctgagaatggaatcttgtccaattaagagttgtgttcccagccggatgtggtggctcacgcctgtaatcccagcactgtgggaggcttaggcgggcggatcatgaggtcaggagatcaagaccatcctggccaacatagtgaaaccccgtctctactaaaaatacaaaaactagctgggcgtggtggcatgcatctgtagtcccagctactccggaggttgagacaggagaatcgcttgaacctgggaggcagaggttgcactgagccaagatcacaccactgcactccagcctgccaacagagcgagactccgtctcaaaaaaaaaaaaaaaaaaagagttgtgttcccatggaaagtactagtagccattcgatttgtgacttttaaaactcaaatccacagaattgtgacctaaatttttccttttgatctgaatgattagactagatttctgagggtctttaagattaaaatattttaattctgggccgggcgtggtggctcacgactgtaatcccagcactttgggaggtctggcaggtcgggagttcgagactgaacctgggaggcagagatgacagtgagccgagattgcgccagcgccactgcactccagtctggtcaacagagcgagacttcgtctcggaaaacaaaaaacaaacaaacaaaaaacattattttaattctttcagataagtaaaagggggcacagcctattagttgggagttcagattaacttgagttgaatctgagctaaaatcataacaagttgggtggggccaccaggcacatagcaactcacctggaatgaacgtgacaagaacagtggaagaggatgagaagaggctttgaaggtgcacactcaacggtattcgaattctgtcacaccagttttgtgacagtattaaaccagagttaggtaatttgaatacctgagcttttgtgctttcagaaacaaaaaaggagggaaataggaaagggaagttctttgatatatagaggcctacaatataccaaagctcactgctagactcttggaatctaatggaagtaaaccatgtttttgtttttgatttttgtctttgagaagctttggtctattgaaaaaattagaatgccatgacagcttaaaagcaaaggcaatcaactgtacctaagaggtggggagaggcttgaaagaggagatgctcttcaactgattctttaaggatgagaacaagtatacgaggtagaagaggtggtggtagaagagatggtggcagtgcttgctggtaaagacacagttataattaatgtagatgatgggcaggaacctaggaaggaaagataaagccaacttgtaaagggcctcctcagccttgtaaatgagcttaacaatgggagccatctaaagtttttaaaaagagaactgtcagattttaaaaggagaactgatgagttttacttttgagaaactgctctgggtggggaaagatctgaaggactaattctctgttactggagagggaccctgagaagctgagccaagatcaaatgccataggaatgtaaagtggcacatagaaggtgaggggagaggtatgatgacttcagagaggattgagtggtgcctttgagacaagagaaagggattagggtgggtgcgtgattcttttcaacaggaagaatctttctttgaggtacctgctggaagccaggtggtatttagcaatctgatgggtttgttattgagaagagaggtaagggctgaatacatatagatttgggaatcgcagcttagatgggatcacccagaatgaggaggcagaacaggaataagtagagaaagagaagctgcggaaggagaggcagccacaagcataggaggaggagccattagtgatggcctgaaagcccagggacagaagggaggggacctgggcattaaatgctggtcagtgataaagaatggtggttactggctggacatggtggctcacgcctgtaatcctagcaccttgggaggcggaggcaggtggattgcctgagctcatgcgttcgagaccagcctggccaacacagtgaaaccctgtctctactaaaatataaaaaattagccaggcatggtggcgtgcgcctatagtcccagctactcgggaggctgaggcaggagaatggcttgaacctgggaggcagagattgcagtgagccaagatcgcaccactgcactccagcttgggtgacagagcaagactccgtctcaaaaaaaaaaaaaaaaaaaaaaaaagaatggtggttaaagcagtttcactagagaagtacttagctcatcttggaattgaattttttttttttttttttgagacagtgtcgctctgtcgcccaggctgaagtgcagtggcatgatctcggttcactgcagtctccacctcccgggttcaagtgattctcctgcctcagtctcctgagtagctgcgattacaggcgcccaccaccatgcccggctaatttttgtatttttagtagagatggggtttcaccatattggaccaggctggtctcaaactcctgacctcaggtgatccaattgcctcggccccctaatgtgctgggattacaggcatgagccagtcaccacgcccagctggaattaagttttctacctttttttttttttttttaactgtgaaatatttcatacatagaaaagagtaagggtgccgtggctcacgcctgtaatctcagcacattgggaagccaagacaggtggatcacttgaggtcaggagttcgagaccagcctggccaacgtggtgaaaccctgtctctactaaaaagacaaaaattagccgggcgtggtggtagatgcctgtaatcccagctacttgggacgctgaggcaggataattgtttgaacccgggaggtggaggttgcaatgagttgagatcgcaccattgcactccagtctgggtaacagagcaagactctgtctcaaaaaaaaaaaaaaaaaaaaaaaaggaaaaagagtaagcctgggcacgttggctcatgtctgtaatcccagcactttgggaggccgagggaggcagatcacttgaggtcaggagtttaagaccagcctggccagcatgtgaaacccatctctgttaaaaatacaaaattagcccggcagtagtggggccctgtaatcccagctactggggaggcttaggcacaagaatagcttgaacccaggaggcagaggttttggtgagctgagatcacaccactacactccagcctgggcaatagagtgagactctgtctcaaaaaaaaagtatatgtaagctgggtgtggtggcatgcacctgtagtcccaaatagtggggaggctgaggtaggaggattgcttgagcccaggagttcaagaccagcctgggcaacataaacccccatctctgcaaaaaattaaacaaggattggctgggcatggtggctcatgcctgtagtcccagctacatgggaggctgaggtgggaggatcacttgagcctgggaggtcaaggctatagtgagccatgatcgtactgctgcactccagcctgggccatagagcaagacgctatctcaaaaaaatttacaaaacaagccaaaaaaaactatcatctgtgtgctccctttaaaaaataaataaataaaacattggccaggcgtggtggcccagactgtaatcccaggactttgggaggctgaggtgggaagattgcttgagctcaggagttcaagaccagcttagacaacatggcaagaccctgtttctaccaaaaatacaaaaattaatcggatgtggtggcatgcacctgtagtcccagctacacagaaggctgaggtgggaggatcgcttgagccttggaggttgaggctgcaatgagccatgattgtgcctctgcactctagctcgggcaacagaacgagatcccatctcaaaaaaaaaaaaaaaaaaaaaaaaaggaatattaccagcacctttgaaacttcctttttctagaagttgattgtattggttcttagcatgcataaggagattttaagcttagaacatattagcacttggtttaaagatgttttgtgtatggtttatacatgtagaaactgagaacgcttttaaccaaaagagctgagagattcgttatcatcagaaaagaaaagtcagttacgaattagttgttaggggctttgctgctcaaagtgtgtagtggacaataggcaaaaagtgagaagcatggtcaagggtgtttggatgggcttgaaaaccctgtgcattttattttattttattttatttatttatttttgagtcggagtctcactctgttacccagactggagtgcagtggcgcgatctcggctcactgcaagctctgcctcccgggttcacaccattctcctgcctcagcctcccgagtagctgggactacaggcgcctgccaccacgctcagctaatttttttgtatttttagtagagatggggtttcactgtgttagccaggatggtctcgatctcctgacctcttgatccgcccgccttggcctcccaaagtgctgggattacaggcgtgagccactgcacctgccttatctatttaattttttgagacggaatctctgtctgtcgcccaggctggagtgcagtggcatgatctcagctcactgcaacctccgcctcccgggttcaagcaattctcttgcctcagcctcccaagtagctgggcctacaggcacacgccaccacacctggctaatttttgtattttaatagtgacagggttttgtcatgttggccaggttggtctcaaactcctgacctcatgatccacctgcctcggccttccaaagtgctaggattgcaggcatgagccactgcgcctgggcaacactttatattttaaagggaagttgggggagggtgctattttcaaccttgctcaaagaacaaataattgggaagcaataaattttctgatgaatatgcttcatatttctttagacagtggggtctaatggaaaggctaagatatctgacatggagcaacatgtatttatctcttcagtggaactaatgtgtaattttcaggggagtttgatgaataaatgagtttgagaatatagggcagaggacttggaatttgtgtcagggttatggctggtgagattgatttggtgtcaaatttatgaatatctctgcagatactaacacagaaaatgagccccaaggtcactatagcagtatagtagtggagggaaatagaaactatctttatcaaatttctacacagacatacccctcaccagggaagcaaggaagttgaaaagcacactttgcctccctaacccaggaatttagatgggggatcagcaaactgttgagtaaagggtcagattttaaatattttcagcttttccatagagtctctgtccaactactcaactatgcctttgtagtgaaaaacagtcatagacaatacgtaaatgaatgggcttggctatcttcttttttttgtttgtttttaagatggagtcttgctctgtcacccaggctggagtgcagtggtgtgatctcagctcattgcaacctctgcctcccaggttcaagcaattctcttccctcggcctcccaagtagctgggcctacaggcgcacgccaccacacctggctaacttttgtatttttagtagtgacagggttttttgtcatgttggccaggttggtcttgaactcctgacctcaagtgatcctcccgcctcggcctcccagtgttgggattacaggcgtgagccaccacacgcctggctttttttttttttttttttttttttttttgagatagagtcttaactgtttcaggcagtgacgtgatcttggctcactgcaagctccgcctcccgggtttacaccattctcctgcctcagcctcccgagtggctgggactacaggcgtgtgccaccacacctggctaattttttgtatttttagtagagagacagggtttcaccgtgttagccaggatggtctcaatctcctgaccttgtgatccgtccacctcagcctcccaaagtgctgggattacaggcgtgagccaccacacactggctaactgcttttaactatacaaataataaaatactcttggatggagtctaaggtggaactgactgtgctcttaatagtgtctgaaatttatatggtacttactggactgttcacaggctctctgtggctcttgaaatagcaggggctgggtgtgatggctcacacctgtaatcccaacactttgggaggccaaggcgagagaattgcttgaggctagaagttcaagacaagccctgaaaacatagtgagacccccatctctacagaaaatttaaaaattggctgtgtgtgatggcaactgcctgtagtcccagctactcaggaggctgaagtgggaggatcacttgagcttgggaagtggaggctacagtgagctgtggttgtgccactctgcactccagccaggatgacagcaagaccctgtctcaaaaaaaagagaaagaaatagaagcagggatatacttgaaggggtatgtgtgtgttcatgtcggtacattggatgcttggtgctgctcggtaattttgaatgcctcacatgcattatgccattaattctcatacacctgacagatgcagggttcgtccctaaggctgattagctcattatgagtgaagagtttagaaccagactccctgagtgcaagtctaacctcttctttggctcctcatttgtaaaatggggataataacagcatctacctcacagactattaaataatccaatctcttcaaagatcgtaaaccatgcctagcatagataataagtatgagctctttattattactcttgctcctactactcttgctagctatttatttttatttttattttattttattttatttttttgagacggagtctcgctctgtcacccaggctggagtgcagtggtgcaatcttggctcactgcaagctccgcctcccgggctcacaccgttctcctgcctcagcctcctgagtaagtgggactacaggcacccaccaccatgcccggctaattttttgtatttttagtagagacggggtttcaccgtgttagccaggatggtctcgatctcctgacctcatgatccgcccacctcagcctcccaaagtgctgggattacaggcatgagccactgcgccggcctcttatttatttatgttttgagacagtcttgttctgttgcccaggctggagtgtaatgatgcagtcatagctcactgcagcttctaactcctgggctcaagtaatgctcctgcctcagcctcttgagtatctgggaccgcaggtgtgtgccactatgcccggctcattttttgtctgtttagtagagacagggttttgatatgttggacaggcaggtctccaagtcatctgcctgccttggcctcccaaggtgctgggattacaggtctgagccaccacgcctggtggatttattatttttaatttggcaagtctgtaagcccttttttgttccttttttttcaagaggccagaggcagaggcctttgtcattttctgtgtgtccagggaagtgtgcaggatgtaagccatagattaggactgggaggaagagtgtgtggtggttgtgacaagggtccaaaggaaggcagcttccgaacttacttgagattataaaaataaatttaaaccaggtatctctgtgtaatcaaaaggtttctgtaaaacagagatggagtgtatgtgtgtgtgtatacttgtaatttgaaaagacattcagaatagtaacttttgggacagtacagactacaaaaattacaacatgatagaaccttcttaactactaagaatatagaaaggaaaataaagccaggcgtggtggctcacacctgtaatgacagcactttgggaggctgaggcgggtggatcacatgaggccagcaggagtttgagaccagcctggccaacatgccaaaatcctgtctctactaaaaatacaaaatttagctgggtatggtgttgcacatctgtaatctcagctactcgggaggctgaggcagaaaaatcacttgaacacgggaggtagaggttacagtgaactgaaattgcgctactgcactccagcctgggtgacagagcaagattctgtctccaaaaaaaaggctgggctcagtggctcacacctgtaatcccagcactttgggaggccgaggcaggcagatcacgaggtcaggagatcaagaccatcctggctaacaaggtgaaattccgtctctactaaaaatagaaaaaattagcggggcgtggtggcatgtgcctgtagtcccagctactcaggaggctgaggcaggagaattgcttgaacttgggatgcagaggttgcagtgagctgagatcctgccactgcactccagcctgggcaacagaacaagactccatctccaaaaaaaatgtagaggccgggcatggtggctcatgcttgtaatcccagcacgttgggaggccgaggtgcgtggatcgcccgaggtcaggagttcaagaccagcctggccaacatggtgaaaccccttctctactaaaaataaaaaaagttacctgggcgtggtagtgggcgcctgtaatcccagctactcaggaggctgaggcaggagcatcacttgaacctgggaggcagagtttgcagtgagctaagatcacgctattgcactccagcctgggcgacaagagcaaaacttgtctcataaaaaaggaaaataatttattatagaggagagtggtatattaagaagtttgacaggcactggcttagagtaagatttttctcttagagtaattttctttctctcttaaggtatccaagcccaccaatgggatctgtctcagcacccaacctgcctacagcagaagataacctggaatatgtacggactctgtatgattttcctgggaatgatgccgaagacctgccctttaaaaagggtgagatcctagtgataatagagaagcctgaagaacagtggtggagtgcccggaacaaggatggccgggttgggatgattcctgtcccttatgtcgaaaagcttgtgagatcctcaccacacggaaagcatggaaataggaattccaacagttatgggatcccagaacctgctcatgcatacgctcaacctcagaccacaactcctctacctgcagtttccggttctcctggggcagcaatcacccctttgccatccacacagaatggacctgtctttgcgaaagcaatccagaaaagagtaccctgtgcttatgacaagactgccttggcattagaggtaaaatctgttcagattagctttttgggtcctttgacatttggttttaatttttagttttagtttagtttctgctcatttaagcttatattcatggaattagagcactggatgattttggaagatacgcactgttagcgtttcattttaaaatttttttatagagacgaggtctctaattttaaaagagttgtttgcccaggctgatttcgaggtcctggcctcaagcaatcctcctacctcgacctcccaaagtactgggattacagatgtgagccaccatgcctggcccattattagtgtttcacagcttgttttgttctgtcctattccttgtttgccccaaattctcagccttcttgctctttcttgttcccaaagcctaacagatttagttttgcagttgttggtttttcttccagtaaggaaagataatgattaaggaagacccatgacctagaggcaaaatcaacatatatggttctgtatttctaacattggaatcagttgagaaatatgaaaatgtcttagaatttctcttgagcttggtagaggaatgaattttttttttttttttttttttttttgagatggagtctcactctgtcgcccaggctggagttcagtggctcaatctccgctcactgcaagctccacctcctgggttcacaccattctcctacctcagcctcccaagtagctggaacgacaggcacccgccaccacgcctggctaatttttttgtattttcagtagagacagggtttcaccgtattagccaggatggtgtcgatctcctgacctcgtgatctgcctatcttggcctcctaaagtgctgggattacaggtgtgagccaccgtgcccggcccaggaatgattttttttgagatggagtcttactttgtcacccaggctccagcacagtggcatgatcttgcctcatggcaacgtctgcctcctgggttcaaatgattatcctgcctcagcctccttagtagctgggattacagatgcctgccaccatgcccgtcgaatttttgtatttttagtatagatggggtttcaccatgttggccaggctggttttgaactcctgacctcaggcgatctgcctgccttggcctcccaaagtgctgggattacagacatgtgcgaccacgcccagccatagaggaatgattttaaaatacatcagcccttgcttgttatggattttgtaaattagaatagcatgaaatagaacttgaacattttaattaccaagtcattttcttttcttttttttttttttgagacagagtctcgctctattgccttgttgcctaagctggagtgcagtggcgtgatcttggctcactgcatcctccgcctcctgagttcaagtgattctcctgcctcagcctcccgagtagcggggctacaggcatgcaccaccctgcccggctaatttttgtatttttagtagagacggggtttcaccatgttggccaggctggtctcgaactcctgacctcaggtgacccacccaccttagcccgcaagtgctgggattacaggcatgatccactgcacttggccaagtcattttcttctaactaaatattactttttaaaaaaactctttctcagctgggcacagtggctcatgcctgtaatcccagcactttgggagggcgaggctggtggataacttgaggtctggagtttgagaccagtctggtcacagacatggtgaaaccccatctctaccaaaaaatacaaaaatgagccagacgtggtgggcatgcacctgtagcctcagctactcaggagactgaggtggaacaattgcttgaaccaggtaattagaggttgcagtgagccgagatcatgacactgcatttaagcctgggcaatagggtgagaccctatctcaaaaaaaggggggagaatgttgagagagagcctaagtgcatttcagaaggatgaagtaagggaccctcttgcttcaaaaaaaccaaatcctgactcaccaaacagcctgcccacagataaaagttagctagaattggtttcatgggtatttttccataggttgtcctcagtgtttttttgtttttgtttttgttttgttttgttttgagacggagtttcgctcttgttgcccaggctggagtgcaatggcacgatctcggttcactgcaacctccgcctcctggattcaagccattctcctgcctcagcctccggagtagctgggattacaggcatgtgccaccatgcccggctaatttttttgtatttttaatagagacggggtttctccatgttggtgaggctggtctcgaactgctgacttcaggtgatctgcccacctcggcctcccaaagtgctgggattacaggcgtgagctaccatgcctggccctcaagtttttctttggaccagtagtagtatctgaatgaactgcacctgaaggtttgtttcaatgtttgattttttgcctccctttcatgttggctataaggaaaaggagcatttgaggctgtggtgggggtcagggactgagaggctccaggtctcaggaggctgcctccacagataggagtgctggctgagcaggccttccagctttctttccttttttttttttcgagatggagtctcatttgttgcccaagctggagtgcagttgatagaatctcagctcactgcaacctctgcctcctgggctcaagcgattcttctgcttcagcctctcaagtagctgggattacaggtgcccgccaccatacccaactgtttttagtagagaccgggtttcactatgttggccaggctggtcttgaactcctagcctctgatcatctgcccgcctcagcctcccaaagtgctcggattacaggcgtgagccgctgcacctggccaggccttccagctttctcacccacacacagacctgcctaggcacaggtgcatgcctctggcctggtctatgcctcagcaccttggtgctctgggctgttaataccctgtagcatgcattgtgttttcagccttttgaggcattttcacgtccatcatagcataggattggggagctaggagtcagagtgggtgtgactcgtgtgtgtttggcagctgctcgttgagaaccttgaaagtcgaggctcccagtcagaattttaggtacctgcctgttgacctctggctctaggatgtgtgttttagaaacctgtatctagtgtgcgtgcgtgtgtgctcactggagcgagtactaggaggttgtagggaggaataccaggtattacagaagggatcacttagagcttggtgagtgggtggataagtaggtgcctgagagaggtcaggagtaggaggaaggaagcctggttaatgattgtgtattttaagataacctacatacttggccatacatagttcctagtctctctggccccagagagaggttctccacacctgagcctcatgacactaacccagccagctgagcttcagccaagggtttgtttggtgcttgactgagagagaatgtaaatgggacctgagaaatagacctttaccaaattccatttagtggtattttgctttctgaatatttaaatgaaactttaggttatagcataagtaaatttttttttttttcgagactgagtctctgtcactcaggctggagtgcagtggcatgatctccgctcgctgcaacctccacctcacgggtttaagcgattctcatgcctcagcctcctgagtagctggggtaaatgtttttatgattgttatcttctaaaactattattaggatagtggtgcctgtctgatcttgttaaaaacaactcttgggacttttgcaattaggttactaggaaaagtattaaaattaaaatgagaaacagacaagtaggacaaaatgtgctgataattgaagcttcgttattcccctagatagtattacagagaatgatgatggcttaggtgactttattccttaaattattttacaattttttttaatcttgattttcaaaagaggattcctgtaagtaaagagatattttaaaaccagtttgtgtttagctattttcttttcttgctgacttttctgcaaggaaagagttgatcctgagatttgatttgaaggggaatacttggtatctgtaaggtgagtagagcttgtgtgatgagactaacgtcactgaatagctgtagacaggtgagcatgctgggcaaagggcaaaagtggcaaaagacagccagggcagtgggctgttgccatatcacgaagggctgagctgaggagattaacaattttcttgcattgccttcatttgagtcatgaaacagccagtttctcacaactgacaaggtcaggtttacaggcaatttctttttatatattaatttttaaatttagagcaaatgcttgactgtcatgtaataatatcattctcattcatttgcattccagtatgcttttctgactaaaacggaagaaatagcaactttagaattgtacttaaccctgggtacacacacccatgactatttgtatgaaaatttgtatttaagtgtctaaatgcagcctcacctgtgcttttcccccatggtgtggcataagaaaacaattggtgacacaagctggggatctgtgggaattgaagtcagtgaaacagatcgtgtggaggaaaaatagtttcccaggcttacaagtgagacttaaagtgatttgggatggaattggtataaatcaagcagaaaggttgtattgataccttaggtcatttagttcaatcattttccctgtgcttttagccctcttcagagtctaactccatggccctccagtctcaacttggacacctccaaaaaaacattcacttcaacaaaagtttattgagtgcctattatgtgacaggctaggaacttgggatacagtagtgaacaaaacaaagatgtatttcctgtggcacatctggaacataagttgctttttttttttttttttttttttttgagacagagtcttgctctgtctcccaggctggagtgcagtggcgccatcttggctcactgcaagctccgcctcccgggttcacgccattctcctgcctcagcctccggagtagctgggactacaggcacctgccaccacgcccggctaatttttttttttgtattttttagtagagacggggcttcaccgtgttagccaggatggtctccatctcctgacctcgtgatccacctgcctaggcctcccaaaatgctgggattacaggcgtgagccaccgcgcctggcccataacagtttcatgaggtggtctgtctcatgttgtatggctgtggtagctgacaagtcttgtgttctggctctccaccagggagaaagaagccacagccaagtccccttcttgtgtttgcctagcccagtgtgtggacttaaaagtgcatggccccatagttgtccctcttgagttttgtagttttgttgttggtttggtttttattggtcttgtcatatgatctgcgtacatctctgaatccttttttttttttttttgagttgaagtctcgctcttgtcgcccaggctggagtgcaatggcgtgatctcggctcactgcaccctctacctcccaggttcaagtgattctcctgcctcagcctcctgagtagctgggattacaggcacctgccaaccgcgcctggctaatttttttatttttagtagagaaagggtttcaccatgttggccaggctggtctcaaactcctaacctcaggcaatccgcccgcctcagcctcccaaagtgctgggattataggcatgagccaccacgcccagcctctgaatcttttaaaatcctggttatgtcatctagcatattcattaccctccagtttcctaactgcaggttttgtaaaagcaccaacagatctttgtactaaagtccttctatgcagcctctccagatctgcctcttatatctataaaaagacagtgaggttgatctggcgtgacttgttcttggtgggctcatgctgcttccagatgctccacttcccattctaaattctcacaaaccatctgttagctaatcgcatccagaattttgtctgggtttcatttcaagctcactgttttacattttatggaatttgccatcttttgacaaaaaacaagagacttgacccttcctaagtcttccagtgtcctgtgatgtaatttctctatgacaggagactagtcttggactcttactgctgtttgccagtgtgtttggtcagctcttaagaacaccctttcctcatctttggtgctccttttttttttttttttttttggcattttttttcttagtgatactcagcgttctttgaggtcaccagcatcctcaacattcttgctcttcattcccataattgctctgtgtcatctgtgattgcgtttttataatttcttcttggattgtctttgccccatttcaaaacctgtagtaatttggattacatctggtctctgtgtcttttgaattggccttcccaagggcccatggtacaacttcctttactgactgacctggaattatcagattcccactttaccaattggttttgcttcattgcttagaattaaatttgtattagcattttcttcattgctgcatctgcttgctgaggtgaagtaatctgcaaagtaagtttaggtttcattaatactgattggactttgtattggactcatgatgaatccctaagagatcatcatgagttcctcctgctgggtggcctgcagtgctcttggggctgtatgtgttcatcatgaagcatctgactcagccctgggggtccatgtggcaagcttacaggctcccagtgtaatggggcttctgtccctcacctcacgtcacattctagcaacgtgaagccttcttaccaaggcttcccagaaaggcccacaagttagcattcaccttaagcaagaatctcaggtgtgtccttcccatgccgtggtggtgtgtggatgtctggtgcccgaggaatcatttccacttgcctccttggacctttcatcaggactgaccaggatcctcctccacccttctgtctttgacattgtgtcagttgtccttcacagcatctcagctttatttctttagtaccaaaagtgctttttttccttgactataataccatgcaaatgtaggaatctttagaaagtcctttagaatattctcgtatttaaaaatatatacatatgtgtgtttgtgtatgtgtatatatatatatattttatgtgtgtgtgtgtgtgtgtgtgtgtgtgtgtgtgtgtgtgtatatatatattttttttttttttttttttttttgagatagagtcttgctctgtcacccaggctggagtgcagtggcatgatatcagctcactgcaacctctgcctcccgggttcaagcagttctctgcctcagcctcccgagtagctgggattacaggtgcccgccaccaggccgggctagtttttgtatttctagtagagatggggtttcaccaccttggctaggctgctcttgaactcctgacaacgtgagccactgcacccggcccagaaaaaaatatttttaaaaggtttttgttcctctttcctaatgtgtaaattaagtcagaatgccatggaattggggccctggtgtggttcaggcagggcctgtcccatcctggtcattaggctgacctctgttttctgtgatagctgttctctggtgatagctgttgagtaagaagaaccatcagctaggggttcacagagagaagtttattctcatgactgctcccacactaagagcttgaggtttatatagtttgccaactatctaccttctgtctatgaatttacctattctacctacctgatataagtaaaatgatacaatatttgtcctttgggtctgaattatttcattgggtacaatgttttcagagttcatccagattgtagcatatatcaaaacttcatttcttgtcccagcatggggtgactcacacctgtaatcccagtgctttgaaaggccaaggtgggaagatcacttgaggcaaggagtttgagaccagcctgggcaacatagtgagactccatctgtacaggaaattatgataaagacttcattcctttagggctgaataatattccattgttatgtatatatcacgttttgttaatccatttatctcttgatggatacttgagttgttttcgttattttggctatggtgaataatgctgcagtggacattgacacacaaatgtttgagtccttgctttcagttattttggttatatatctcagagtggatttctgggtcaaatgggtaattctgtgtttagctttttttttttgaaacggagttttgctctgttgcccaggctggagtgcagtggcaccatctcggctcactgcaacctccatctcctgggttcaagcgatttctcctgcctcagcctcctgagtagctgggattataggcacgtgccaccacacctggctaatttttgtattttttagtagagacagggttttgccatgttagccaggctttgaactcctgacctcaactgatcgctcacctcagcctcccaaagtgctgggattataggcatgagcctcctatgtttagctttttgaggaactgtcaaactattttccatagcagctgtaccatattccattccaaccagcagtatataagggctcccttcttcaccgccaaaaaaaaattcttccacatcctcatcaacacttgttattttccatattttttattatagccatcctagtaggtgtgaagtggtatgtcattgtggttttgatttgcatgttcctagtgactgatgttgagcatcttttcatattggcttttggcaaatctttggataaatattttcaagttctttgcccattttttaattgggttatttgagcgtttttgttttttattttgttttatattttttgagacagagtctcactctgtcgccctggctggagtacaatggcactcacgatctcgactcactgcaacttctgccttccagattcaagcaattctcctgcctcagcctcccaaatagccaggattacaggcactcaccaccataccccgctaattttttgtatttttagtagagatggggttttaccatgttggccaggctcttctggactcctaaagtgaggtgatccacctgccttggcctcccaaagtgccaggattacaggcgtgcgccaccatgcctgaccttagttattgtatttaggctgttgatccattttaaatgactttttgtgtatagtgtgaggtaaggtttcagagtctttcttttgcatgtggaaattggtgcagttgtcccagcaaggttattctttccctgttgaatagacttggcaccctagtcaaaaatcagttggccaagctgggtgtggtggtgcacacctgtaatcccaggtaccctggagactgaggtgagaagattgcttgagcctaggagttgaagatcagcctgggctacatagtgagactcccacgtgttaaaaaaaaatcacttgatcataaatgtgtgggtttatttttgacctctgagttctattccattgttctatatgtctctccatatgccagcaccacactgttgattactatagctttttgtagtaattttgaagtcaaggaagtgtaagtcctctaactttgatgcttttcaaggttgttttggctattcaggttcctcgcaattctatatgaatttgaggattggttttcccattgctgcaaaaaaaaaggctgttagaattttgatagggattgtgttgtatttgtagatcactttgggtagtattagctttttttttttttttttttttaatttcttttatgaggcagggtctcactatgttgcccagactggtctcaaactcctgggctcaagtgatcctcctgtctcagcctcccaaagtgctggcattacaggtgtgagccactgcacctagccaatattaatatcttaatcataagtctttccatccattaacacaaatgtttttgcatttatttaggtctttaataatttttggtatgcaagtgtttcaccatggttaaattattctcgttttgttttgttttgtttagacagagtcttggctttgtcaccaggctggagtgcagtggtgcaatctcggctcactgcaacctccacctccctggttcaagcgattctcctgcctcagcctcccaagtagctgggactacagacatgcgccaccatgcccagctaatttttgtatttttagtagagatggggtttcactatgttggccaggatggtctcgatctcttgacctcgtgatccacctgcctcggcctcccaaagtgctgggattacaggcatgagccaccgcacagcctattcttggatatttttattttagatgctattgtaaatggaatcacttttttttttttcttcttggagacagagcctcactcccgctccattgcccaggctagagtgcagtggcacaattcttgtgcctcagcctcctgagtagctgggactacaggtgcctgccaccacgcccagctaacttttttttgtattttagtagaattggggttttaccatgttgcccagcatgatcttggcgcctcccaaagtgctaggattcaggcatgagctaccgtgccctgcctggaattactttctttctttttttttgggatggagtttcgctctatcacccgggctggagtgcagtggtgtgatcttggctcactgcaagcgccacctcccgggtgcacgccattctcctgactcagcctcccaagtagctgggactacaggcgcctcctaccacgcccggctaattttttgtatttttagtagagacggggtttcacggtattagccaggatggtctcgatctcctgacctcctgatctgcctgcctcggcctcccaaagtgctgggattacaggcatgagccaccgcacccggcttggaattactttcttaattattcattaccaatatataagacgcaactgatatctatgtgttgatctcgtaccctgcgactttgctgaatttgtatcttttcttatatatatgatcgtgtcttgacttcctcttttccaaaagcccacatactcttgtaccacagcatactggcctgtgatacctttagccccgccccctacctttcccaaataaaatctctgtgttaaccagtaaacagccctcttgaatcaagttactactctgaaggatagtggtaattttaagaaagagaccaagtcttcagtattaaaaccctattagatagcattcagttgtgggtttgagtgtatgagattacttgactgctagccagggcacacagacagggagcctagccctcttaaagcctctatctctctggctactctgattcaggtgcaggtgcacagagaacacaggggcaggcagtggacccatgcagctccgtgagggccaggggtgtttgtctcctttgtgtcctctgttgtatctcttcacggcctacacatagatgttcaatatttgttgaatgactagaggaataaaagccacagagagcaggatgatacctgtctggtgattatagtacatgggctttgttttgttttagatattttgggggctataagcccctttgagaatccagtgaaagttgtgcagtcttcagaaaaacagcatacattcatgtatttgcatacaacttcgcaggatgttctttgatcactgagacccattcacatcactcaagttagaatttatgattccagtgtcaccagtgtactcctgatcttacttttatgtaacctgaaagcatacaatctcagcctatcagtacagggagcggagactgattatggaaccaaaaaactgctgtgacgaccagtgcttgggccctccagtgcgttgactgctctttgaatcaagtgccagatgccagtcagtagagtcatttcctggacaacactctggacaagtagggctgtaggaaactattgccagcagcaagaggtaccctcttgccatttaactcttggtagacataaaagggctgactagtgtccctggcatatgtgttttagagttaatgtgtccactccccaggtgctaagtgcggccagccacaaagatagtgttttgacagttctaataatgattaggattggcctgttccatagagtgaaaattaataaggatgatgcattaggtatgtgcttcctcttaatctgttgataaggtcagccacatctcccaggtgtagtttgccccgtgaactgagttggtatctacccacatcaagattggtctgccctctaagactatactttcagggatcatttctatagttcattactagagaagtttctctgaaggtgtagagcacccctccctccaaaaaaaaaaaacagattgatctgccctccacagtgagtgcttctttgagctggatccgtgtaccatgaacccagaggaagagcaccacaccagaatagggagtgatgagggaaacggcaagatggctgccaagctaccagccattttaggatctgagcacaagcactgtttggtagagccatggaagaagctggtccatagccaggcctgtaactggacagcaggctgcataacagccaggatatctttactgtgttgagatagaaaacagcatgaagaatgatgatggtgttttagcatgtggaaactcctgcaaggccacaatgaggcactaatggtcaaggggccaccagaagtctctcagccattctcttcctaggctgctctttgacctacttctgctggtccaggttccctctgtctaagcagtagctccttgaatcctgtgctctgcagcattgagttaatagtgtttttctgccacttgctgcttttatgtgttttctgtctctctctcttttttttttttttcaatagaagctaggtctcactatgtcacccaggctggtcttgaacatgtggcctcaagtgatcctcccaccttggcttcccaaagtgctgggattacaggtgtgagccactgcgcccagctacaccaagtgcagtgacacgattttggctcactgcaacctccacctcccaggttcaagtgattctcctgcgtcagcctcccgagtagttggaatttgggattacaggcatctgccaccacgcctggtgatttttgtatttttcagtagagatgaggttttgccgtgttggccatgctggtctcgaactcctgacctcaggtgatccatctgccttggcctcccaaagtgttgggattacagatgtgagccactgcgcctaggctttttcttttcttttcttttcttttttctttttttcatttttttttttttttttttttgagacagggtcttgctctgtcacccaggctggagtgcagtagtgtgatcacagcttactgcacccctgcaacctctgcctcctgcgcttaaacgatcttcgcacctcattctcccaagtagctgggactgcaggtgcatgccaccacgcctggctcatttttgtattttagagacagggtttcactgtgttgcccaggctggtcttgaactcctgggctcaagtgatccacccacttcagcttcccaaagtgctgggattacaggtgtgagccactgcgcccggccactttgtgcttttcacactatgttattatctgacaaagattcattgtgtatcccactcaaaagacagaagttttttaaggatacgaactgacctgcccattttccatggagtagatgttcagtaaatttatttaattgattaggtaggatcatgtagaaagtatcctgttgaagaccgccagactcacaagttaattggaaggcgtgaggtgtgagtgttcttggcagctttcaatccttagcctcatctttaatcttcccgtagtcttctttggctgcttagtatccatcacagtcatttattagaccccgttttcagcctgttcctcattggttttgagaggacccttgttggtgacaaggttggaaatcctctgatatatacagtgttgtgcttctcagtgctaattccagctcttcccttcgtgcatccaaagggtatgatcattagagggggcgtggggttgggggatgggttctattcaggaatctctactcaagtaacaatcatttaattactgcaagaacctttcaaagttggaaggaaactgagacttggagaacttaagcagtttgctacagtcatgtagtttctaaaagtggcagaaccaggacatttgtttggtgtcctgcatgctccaaagttcatggcacggaccattggactgtgccataaaaaccttatgcctgtttttattttgagatgtagtcttgctgcgttgcgccggctggtctcaaactcctgggctcaagcagtcctcccacctcagtctgccaaggacctggaactagaggcatgtaccacgatgcctggttctatatgtgtttaagcagacaaaagcttatttcttattgtcttagatcttaggtgggtcttatattcaagtagcgtttttatggacctaagtacacaatacagaaccttagattagtgctctgctgaacagagtaacaccctgtctacaatgactaccacctgaaggtctttttttaaaatacacctttttgtgtaatttgactttaaccattctcagaatcatgtgttcatttctatcctgttggggttagtggccaaaatagaaggttggtgtggggtggggagctgctttgtgctcaaaagctgtttctgtgtgtgtgtgtgttttgatttttgtttttttgagacagggtctcactcggttgcccagtctggggtgccgtggcactatcacggctcactgcagcctcagcctcatgggctcaagccatcctctcacttcagcctcctgagtagttgggactgcagtcatgtaccaccacacccggctaatttttctattttttagaagagatgaggtttcaccatgttgcccaggctggtctcgaactcctgacctcaagtaatcccaggagttcaaggttacaatgagctgtaatcgggccactgcattccagcctgggcgacagaccccgtctataaaaaattaaaaaataatgtgcatggtggtgcacgcctgtagtcacagctattcaagaggtggaggtggaaggatcacttgagcccaggcgttagaggttacattgagcagggatctcaccactacactccagcatggctaacagagtgagaccctgtgtctaaataataatgtatgggccctttggataaggtagtgtttgtgatttaatgtaaactgtctttttcttgttgcagagaaatgctaactttgtcttcttcatccatacaggttggtgacatcgtgaaagtcacaaggatgaatataaatggccagtgggaaggcgaagtgaacgggcgcaaagggcttttcccctttacgcacgtcaaaatctttgaccctcaaaacccagatgaaaacgagtgattgctgttgccctgtttcctgctgctttgttgttctgcctgtcctagtctcctttgaagtgggaaagcattttctctcataggcaagtcacactgcattgccgaagtccagctttctgcagactggcagtcgcacacacatttggaatgcacacagcggctgcctcctgatgtttgtatcatagtcgtattgtcaaagagtagccgattttagagttcttttggatcataaactggaaatactgatggaagcacacaagtggagagaagttgacatggaaagggtcttccttctcattgctgcccgtttgtacatgggactgattctgttgtgttcaccagagaaagcttgaggccatggcgagatactgcatgtttgctgttccacaaagcagtggcttagctgccatcttgcttttctttggacaacaggaagtgaaccttaaggaagagagaattctgttctaaaactccaaaatctggcttttttttttcttttgttttggtttggttttggaaaactaattaattagacttgtgtgggggtttttttttgttttgttttgtttgttttgttttgtttttttgagacggtgtctcgctgcatcacccaggctggagtgcagtggcgcaatctcgccttcctgcagtctccgcctcctgagttcaagcgattctcctgcctcagcctcccaagtagctgggactgcaggcgcgcacaccacgcccagctaatttttgtatttttagtagagacggggtttcatcatgttgaccaggctggtctcaaactcctgacttcaggtgatccacccgccttcagcctcccaacgtgctgggattacagccgtgagccgccgcgcctggcctagacttgtgtgttctaaacaggttaagtagcaggttgggtttttatgatagtgcaaggaatgactcatgcctctgagcttctaaactgaagctgctgtaactaaaggaatctgaaaagaacaaccctgaagcagaggcctttattgtcttggttgccagtagtaccttgttttgccatgtagcagacaacacacaaaataatgcagttgtggtgtgccatgctatgtgcacagccccttggattactttgttttaaaaagcatcagagttgggggtactttagggaaacctttgcttaccttgttttgccagtgataagagcagtgggttggagggcacttggccagttttctgttcagcttttcagtgaatgtacccctttaaggttcagacttaaacttccttaaaaagtggcgttgttcatagaatcgttggactcattaatgaatcgttcaactccactcactgaagcccagacctccgtgcccaggcccaatctcgtcaggctgccagagaaagttggtgctgctcatactggtctcacagtctaagtaagtgtctgtgatgctcccaagcaaaggaaatgcaagctctggaaattcgttaatgtatttgatgtcttagtgttttagtgactagggagaccattaactagtttatcattaaccacttatcagtgtattgatgttaaagcatttccctgttagctaaaagaggcctgttcatacaagccaactggtatatacgtgtggttcatccatcatctgctgcacatagcagactagaattctgggaaccctgtgcaattcagtctgctctcccttgtggaccctggtaaagaaaagcctcagctcatagtgaacacagcagacctagaaatgtagcagcagcctactgagtagctttcatttactgatcatctgctgtgactgtggccctgtctggaggttcctaggttttgagatttagagcaatgcattctggagacagaaccagcagaacagccatttttcaatttttctttaaatcagtattccatcaggcagataactgctgtattcatgaatcttgagagtgttcctgagacagaattaatggtcatttgggaaaactatcgccatggcttcccatctgtggttttcctctaaaagccttggagattagcccttccttgccagtgagaacggtgaccgcctcctgctctgcacggtctgcggcagttgccgcttctggttaggtgtgtcaggttggcttattttgggttcaggcctggcgtagcacccacaagtggcagacatatcacaagagtccccagactctgcctagaaacagtgtttgccctttggccagtgacgtggttcatcccggcccatgttgagccatgagtggagtttccaacagagggaggaatgtgtgccttgttcaaggagggcacgacccttaggcctttttcaaccagatttagctgaagggcttgacacctttgaattacagcagttgactcagagtgcaagaagtctggccattttggaaagcaaggtttcctttcagccctgtctactgaccaataccccgactcaccttgtgtggcgcacttcagaatcagatatacctagagtatacctgtggtttggttttataattaatcagctcgttacttcagcccatgaaaatggcatccagggctgccaggagattcagagctcaaaacaaggcgagcttgagttctgcactccagatatgtgccaaaactagtaaaacttaacggacttacaaccttgtcagtttttttaatgaggcagggatactctgtttttcacactaaacatatgaatgcagcactgctgcctcagctcagcttcgtgcctgggttccccactggtctgggaagactgttgtgctccatagagcagtgcacatctgacccagagggtgggtgttcataactgctacttgctctgctctaccatgtttaaagaaatatttggatgttaaattaactcactatggtttttcacctgggaaggaaacaaattacgtactagagggcattgactggttaaaaacttgtgtatcccgggaaggacctgcggtacaggagtcagccatgtctgtgctgtgtggaaccacctgatgacatggttaacgaggaagacgatgtgttgaccggctgccgtttgaggactttggtcacccagactagacaccttctgtgctcatgtttggaaagctgaaagggaaggacagctgtgccctcctgggagctcatgtgtccctggcgctgtgctagctttcctttacagctgtttacagacaaggcaggcctgaggcagatggccactgctcttgtgatgtttgctcagaggaatatgaacattttatttttgaaaagggatgatgtggttttttgccaggtgtttataattaatcctttaatattatggttattaacctcttaaacatgaatgaattcttgattgttttaacacagtacctaagactaatgctttctgtggacaccactgagctctgcctcaactccaccctctgcgaccggaggactatgcccctagtaactgctgtcggtgtggacgctgtgctggttctgttttctaaaggagcagaaggacaggtctctgagacaggatcgttgtccctacaggaggaacagtggccttgcttcttagacggtcttcactgtgtgttttaaaacaacaacaacaacaacaacaacaacataaaactcttttgacctgtaacttaaagatcataaacttcaggcaataatattttctgtgtaagcttttaaaattatttttggggatcatagcttgttttattttgtgctataaaattaacagtattaaatgacttatattcttagaatacatcgagtgtcttttcttaacagattagtgcctttttatttttgtattccgttttacgttactggtcccagcatcaaaacccttgtttccatggcctgtttgtatattgtctcaataaaacttgcatcagccggtggtggcggcagc

SEQ ID NO: 1041 - DNA, 2214 bp, Homo sapiens
ggtatctttccttttatttaagcctttttgtcatcatggttttacagtttgcagcaaacagaatgtgcacatattttatattatttataattgggtatttcattttttttggtgctattattaatggcacttttctcaaaattttcaattttcaactgttacagatagattatataaatatgatgaatttttgttacgttgaccttatatctggagaccttgcttaaacacacttattagttctaataactttcctgtagattccctaggattttctatgcaatcatgtgatctgcaaagggagatggtttcatttcttcccctctggcctggatggtttttcatttcttcttgccttctggcactggctttgacctcaagcacaatgatgacagggtggcaagagtagacactcttagcttgttggaggggacattctgatgcttaacacatgacatcctattcccagagtctccagttttggtgatagtgtctcggttcttgagcactttccagaagaaggccctaggagagtcaggagcccatggaagcatggccacagggcaggcagagcagggcccagctaagtcgctctggccgtgcaggagagagggctgcagctgctctgggcccacccagatgcactaagggccctgctctgctaagaagtccttggggctgggcaggctctttaggccatacatgcccacaaatgggtcatccttgtacacatctgggcattcttacaaagcttggacagagtggcaaggcagcactggtagactcctgagaaatggaaccaggagtccaggtagcatggcttgtgaacagagtttgactcttgtagccagtcactaagctgggggtttaaagttatgtggccgggcacagggaacttgataagcactcaaccagtgcttctcatggccctaaacagacatgcaccctatacgaggagaaactgccctgcagaatggggtccaagcatcaccctctagctctgggtcctctggtgggcttggctgcaaatgtagccttgtgctcaccacagtcaactgcacatgtctgatggtacatgccacagtgcccactttcacccagcctcaggcacagcctctggaggacagctttgtcctcccacccagcagccccccagtgtggagggacactgacaacattccactcaggggcagctttcactgttgtggcccagcctctagctgcagcctctcctccacagggcccctagagacagagatggccatcacaccctgcccaagctgctcttctacaggggccacaagtccaggggcttccaaaagtccccatcatttcattcctactgtggcacccaagaaagaaagaaactcatacttttgatttacatttctcttgagatctgaattcacacagagctgcagctacaccggtgtgcagaatgacaaagcatgcccgtggagtgtgaggggtgttaacatctcagagagcagtggcccacctgctcctctctttttgcaagtggaagggagaggatcaccctgagatcagattccctgtagtgtctaccttaaagcccccgcctggtggtgaggagtctgatctcgaaactgagaataatacttcatctttttctcgaagattctaaggtaaaaatggatgactgtaagcaatgacaactgtcactaccctccatatcatcatactagagaacaggaagagctccaatgtggacataaattagaagtctaggctggacgcggtggctcatgcctgtaatcccagcactttgggaagctgaggtgggtggatcactcgaggccaggagttgaagacctggtctggacaacatggcgaaaccccgtctctactaaaaatacaaaaactagccaggcatggtggcatgcgcctgtagttccagctactggtgaggctgaggcaggagaacggcttaaaccctggaggcgtaagtttgaagacaagtttgaagctgtcagtggtgacttgtgaacaaacagccacacttgagttcaagttcatttgtgaatgctgcctgtcaccccagaatgggaaggaggcagctggaggggtcgtgtcagacacgcccactagagtagtggcatcaaagtctctgagacatctctgtgacaaacgctgccattgctgctgcgcgatgctccataaactctcctgagtcctcaccactgaggaagcaaa

SEQ ID NO: 1042 - DNA, 14399 bp, Homo sapiens
taggaaagaagggagtttatcactgtaactggatacagggagaaggctggagataattccagcagaccaactcaaagtgctacaattttcttactgtttatataggttggggttatgtgcctacatgcagtacagcaatcacctaagtctactggtaactaattttgttccaaggagaaggtcagaggcaaaaaaaatgcttgctaagtccgattaaaaggggcccagtgccttcaaggcctgtctactgtggtaccggagtgattatttcgattgtatctcctttacagcttggtccagagagctgccttagactatccaattgatctattcaaacagctgcctgttcccttaacttgtcttcagattttgtcgacccgagatgggtcctggcactaggaatgtaaaaccgttcctattattttggcttgctccagcaaaagagaagcccatgcaaggctcctgctgaccatgtttcatttctagctttgatgtctgggcactgatttccctagatttaactatgtgctcaatggtaaggcagtgctgtggaaatctgtctgtgtaactggggtgctatgcaggcctgtctgggtgactgtcagggacaactgtcctaccacaccaaggacacagccctgggggtgcttttcttcatagccaaagaagctgcaggaaacccaccctagtgggacaaagaccaatgcagggtcagtccccacagccaggtgatgcaaacaggctggacgtgggccgcctcccctccagcttgacttgtgacagggaaaccaatgcagcagcagcagggccaccagagtcctgtcctggggacaggcttccttccagcgggcggggagtgggtgctcctgccagaccagcctggcttccacggttccagagaccctgttctccctcagcccagtccccgcccccactccttggctttatgagttcattggctgaagtcacccggagacaatgctgagtgttccacccctgagtcgaagcccagcccagggcagcccagccagacgcctccggtagtgtaaatgaggacaatgcctgctggcccacatgacggggggatgtagacggcagcggcgccagtcgctcctggcaccatggacgatgccacagtcctaaggaagaagggttacatcgtaggcatcaatcttggcaagggttcctacgcaaaagtcaaatctgcctactctgagcgcctcaagttcaatgtggctgtcaagatcatcgaccgcaagaaaacacctactgactttgtggagagattccttcctcgggagatggacatcctggcaactgtcaaccacggctccatcatcaagacttacgagatctttgagacctctgacggacggatctacatcatcatggagcttggcgtccagggcgacctcctcgagttcatcaagtgccagggagccctgcatgaggacgtggcacgcaagatgttccgacagctctcctccgccgtcaagtactgccacgacctggacatcgtccaccgggacctcaagtgcgagaaccttctcctcgacaaggacttcaacatcaagctgtctgactttggcttctccaagcgctgcctgcgggacagcaatgggcgcatcatcctcagcaagaccttctgcgggtcggcagcatatgcagcccccgaggtgctgcagagcatcccctaccagcccaaggtgtatgacatctggagcctgggcgtgatcctgtacatcatggtctgcggctccatgccctatgacgactccgacatcaggaagatgctgcgtatccagaaggagcaccgtgtggacttcccgcgctccaagaacctgacctgcgagtgcaaggacctcatctaccgcatgctgcagcccgacgtcagccagcggctccacatcgatgagatcctcagccactcgtggctgcagccccccaagcccaaagccacgtcttctgcctccttcaagagggagggggagggcaagtaccgcgctgagtgcaaactggacaccaagacaggcttgaggcccgaccaccggcccgaccacaagcttggagccaaaacccagcaccggctgctggtggtgcccgagaacgagaacaggatggaggacaggctggccgagacctccagggccaaagaccatcacatctccggagctgaggtggggaaagcaagcacctagcatgacaatggccccgttgtgtgtggtgggggtcggggttggggggcatggtgcagtcggccttcacgtaaactaagtaggcaggtaggatctgaagaaggcacaggtgcaagtaaaattcgtcaattaaaccactattttgattacgttccattagctttcttccacttagcagcaaagacgttccttactgaccaccaaataaaccacagggtgtgtgcaagcatcaagagtgcccagtgaggagtgtttttctctgggactcagccaaccgccccacctgacacacagtggtctccggcctaggagcacaggacagatgctcaggtacaggcagaatcacagtgtggcctggccttgtgggggacaagagggcctctgccagggtccacccaccaggcccacactgtctccctctgacctggccttgtccccaatgccctggggctggccagctccagtggtccacgactccccctggcttcctgcagttcagccccctctgacctacccccactccctcacaatccctcgctcagcatcctcctcttcctctatttcctggagtcatgtgagatttctgtcctcagccctcaagttccctgccctgtcctccaggggcagccccagctgagacctccccgtgtgccctccccacccagtggctcttcaagctgctcagcagcccttgatgatggcacactggccggtcttttgtgcttcctgctgggtcacccattgctcccaaagcatgcggcccacttgctggccaagtgctccaggtggtcagcacctagacatgctcctcccccctccctccccacttcctgggggctcccttgggataacgtgcaccctttcctaggggataaagcactgaaggccccacgtcccccaccccttaagagtcccagcctgatctgtccagcaacccactgttatctgggagctcctgttggtggaagtgaccaggtgaggccagggccagcagcataagatgggcagtgcctatagcagaggggtgagtgggatagtcccaccccatgagctggaagccaggtgctgggagaaggtgatagctgagatcacctgatatgcagcccccacacagtcctataaccagcgcacctcacagccggcaagcccagagtggaggctgcagacctgggcccagaaccgcaggggaacctaagggtacaacttccaagggctccgtttctccttcatatccccccagagaagcagaaagcactgcaggatgtgagctcaactcagaacacaggttccgagtgccgcagaaagcaacgccagtcacccggtgctcccacagccgccccacctgcagcttcctcacctggggggcccctcgcttcaagccccgcagtcctgagacgtgatgcaggccccagggcaaggctagggctcgtgtggggagcaagatggagaggcaaccccccagactgtacctaggtgttctttaatgacagttcaaggggccaattaaacagcaaacagcttggcaaggccctggggtgtggtgtgggcacgagtgccttgtgccagtctggccccagcacagcccctttctccagtgactcctggtatggtcaacagcttctggcccaggcctgggccccgagaaggctggagtcctctgctgggtgtacagctgccctgcaggctctgtgaagcgtctatgagcccagcccaggcctggctctaaaagaagtccgaagctttgcgccgggcagggagctgcagcaggttgtccgtgatggaggccgggtcctgtgtgagaggggtgcgtgtggcagagccaggcgccggtgtgcttgtgggggtctgcagcccactggccggggtcttgaggtgggtggagcgtgctggggatggtgtgtagctggcccgcagggcccggtctgtgtacttgctggccgtcctgctcacaaggcgctgtagggctggcgacatggctgggctcaggcctttgggggtgaggctggggtggaggaatgggtgagagaggcagggttaggtgggctgagagctgccggcagcagggcctcccttggctcccaggaagagcctgggcagagacacagtcactctgagctgaggaggatggtactgccagcatggcagcaaatgcgggggatccctgaggtcaaacagcagcgctcaggtcaaacctgaggtcaaacagcagcaccgcccttggctgtgggggctggggtgcacccccaggcctctgagagttggagtccccacccctctccaaggggaacgatgactctctccacagggctgatgaaagctcccagcaggaccacacgcctaaagatgcctcttagggacgggtcaaagaggacgtggaggaaagagaagatggagggggcctctcatcctgtccatgtgcggccatgctctggatagaggagctgccacagtacccactgcagaaccccgcggacctgccctggactctgccgcgtgggccatgcctccacacggtcagggcaggggccgaacaggagcaggccagagccaccctcgcacttccccaccagccaggcggcccctcacctggccagattctccgtcactctccgcaaggcttcctgcttcttggcccggttcttggcagcggcctcgttggccatcttcagacccagccgctccctgcggcctggctccaggatctacaaggtagcaggtgtgtgggtagctgcgccaggcctgccacacgccaggcagcccctcacacagaaagccactgtggtgggtgccagcctctctttgttgcctacaaaacccccacaacccatcacctcccactaaaagcccctggaaagccccaaaccccacctgacctgcccaaggcgcagcactcctcacctgtcttcgtgttcctcccaaaaccatgacctctgacaatctctcaggaaaaagcagtctgttttagtgtttccctgattatcagagtgaacatctctgtctttatcggcgctctgtatttcgggcgcttccccgtgtgcctgtggcctattttgctctcaaggggctcattttccttttctgctgctgttactcagaagacccttgccaagaccttgtgtcaagtcaactgtgctacgctgtgcacatgttttttcactcatttacatttgtttcatttataacattttctgctgtatttgttattttcatttgtgatttcttcctttgcttttatgtttagaaagtccctcctaacttaagattagactacaggctgggagtggtggctcacacctggaacctcagcactttgggaggccaaggtgggaggatcacttgagctcaggcattggagaccagcctgagcaaaatgacaagacctcatttctacacacacacacacaaaattagctgggcatggtggtgtatgctgttagtcccagctacacaggaggctgaggctggaaggtcatttgagcccaggagctcaatgttacaatcagctatgattgcaccactgttctccagcctgggcaacagagtgaaaccctatctgttaaaaaaaaaaaaaaaaaaaaaaaagaggcgaggcacagtggctcacgcctgtaatcccagcactttgggaggctgaggtgggtggatcacgaggtcaggagttcgaaaccagtctggccaaggagttcgagaccagtctggccaacatggtgaaaccccatctctactaaaaatacaaaaataagccgggcgtggtggcacgcgcctgtagtcccagttacttgggaggttgaggcaggagaatcacttgaacccaaaaatcaaactaaatattcgccactattttctagtcccagttacttgggaggttgaggcaggagaatcacttgaacccaaaaatcaaactaaatattcgccactattttcttctggttgttttatggttattgtttttacatgtaaccttttcacctttccacaatgtatgctgctacacatcctgaggacccagctcccttcatttctaaatactctgctattcagtgcaatctgagttgccatctttatcgggccccaaattctgacttggatcatggtttgtttcagaatttatctgtttactgttggcctggagactcgggaagcagtggcaggcatacctcagaagcacctcagcccttgccttgcgctctcacattggacagcacggcatcctcttcattatccctctcgcacgtttgccttggttatccttgtgtcccagacaatttagaaccaaggtaaccagaacctctccccatgttttgtctggacatgggttacctgtactaagtattctggggaaaggcccgcagtggtatggggaggcctgttgtatctgacccagcccacgaagagcctcccctggtctgtgccgggcctcacacactccaccctgaccactcctacaacaccaggcttgagccgtgtaatccagcgtgtcccaatcgtgttctgtaaccaggggccttctctacaagcacacagcctcgtcctatggccctcaggcctgcagagctcctcacgtgtctgtgaccatcctgcctcattcatgaacagcacccggcctccaggatccagagggcccaagccactccctgccttggtgtctcagcccttacacccccaaatccctctgtgacaggtccacccacccacacctgccttcagcaccctggcattcagaaaagccagcactctgcccgtcagcagctgggggccgatcccagtgctcagtcctgagccacaggcactcagggctccagaggtgtccaccccggtcgcacacagttcccccatcaccacaacccaccttaaaagctgggccgggtgtcctgtccacgtagggcgtttccgacccttcaactctcaagggtgtgttctcaacctccccccaggtcatcatcggggactcgttcacacctgcagacaaagagcccaaaaccacctcaggccagaggactccccaccaccctcccctccagtcacagcttgttcacccaatgtgcatcccagctaatacgaaggcaggcagctagccctctctccttccccaggactctggaaccctggcacctccatcctccgaaagggaaatgccaagctcccagcaggcccgaggcaggctcaaggccctacagccatgtgcttagcctacaagcctctgggaggtctcccccagccacgcaggaggagacactcaggccttccagggctcccaaacctcctagaaccccaggcaaacctgtggtgccttcacatgccctggcgtgtgacacagcaccagcacccaagagcacagaggccagagtgcagagggacacccacgcatgccacaagaccacctgagtttcacctccactgaggtgctgggcctccctccctgcagtgctaggtagacttagactcataagcactgtgcacacacccccacccactgacatcacagtaaggaccaggacaggacacgtcatcccaggatgtctcaggccaggtctgcctgagagtccagcccacccacggccccaagcagcctggacacctggcctctagggccttgtacagacaggagaccaggtccctgagttacacaaggtgtggggcaggccaggtagaggccaggagtggccagggccgactgagaagcccacctcccccagggagtcccagcagtagacccacttgccagtgggcacttttctcaccaggggcaggggaaggagtggcaacaaatccaaatccacccactcgaggggactcctgggggatcagctccttgccatcggggcccaccttgccctgtttgtgctggaacaagcagagaggctggcatcagggggaccgcagcccacgctcgacagctggccggtgggcaaacacgtgggaacatgctggaaacacttcctctcctcagggcaaggctggggctctggggttggcagccttcttggagaaagagagggagggcccctgccccaaccccccaaaagaccttgagggcctgtcaaagtgggtacccaagcaaggaaagccccctcctcccatccagggaggtgccagggcctccactcgagctgcgcctatcccagcaactccagaggatgctgacgccaggcccctgcagggggcaatgctgatgacaggcaatgctgatgacaggcaatgcttatgctctagtctcttcctgccttccccacttcaaccctgtgactgccacagtcaccatcagagagtatctactcgtcttgctcccagactcagaaagcctctgctctctgccaacccagggcctgtcccaccccagccaccccctggggctgggctccctctgcggctctctggcttccctgcccggtgtgtgggcgtgcagctgccagcctgggctcactcccagcagtcccttttctctcctgcccctgccatcaagggagctggcacagatctggacctacagaacgtgtgtgaccaaggcagtgttcaatggaagcccactggggccaaggaaagactcaggatcctgccgcacagggccccagatggttccactcactgagctctgccaagctcaaagagatgggagagatcatgcctgcccccaggcagccctgtccaacctggcccatgcggccctgctgacccgcctgctcacctgggcattgagggcggctgcctgctggagctggcacctgctcagggcttggctgaaggggtccctaaggaagcgcgtgttcttatgtaccacctgccggggcttcttaaacagctgctcctcgtcagggacacctggcagacgaagcaaaggtagcagcaggtgtcagaagggcagcagcctaaggagcatgaggagctcgcttctcggccaagtcactcccagatgaacaaaagcattgagcagaacgcaggccccagtgccgctggagagggtctcactcactgctgacctcacacagacctgtccacccttagacagaccagtacccatcagaagcccaaactgcaagggggcacggccatacacacctggaaggctgctccaaacacagccagacacacacagctctacccaacacctccccatttggctgcgaggcccgccacttaccctctggatagtacatgagggaattcttggccttgtacttccaggtctccacactggcctggctgctctcgatggcctggtgctctgctgacgggagttcgagattatctttctgcctctgcaatcacatggggaaaagtgatggtcagagatgcccctgggcattgtacccatggccctggggctccccaaccaccacagagggtgcctacgcctatgtgacaccccagaccccagagacaccttctcaaactcttcctcagcctggtagagccaagcgtggcgtgcccggcttctctccttggccacctccatgatctcctggaaggaggcattgtcctcactcgtgtagcggctcaggaagacatctaggctgggcagcggctccttctcctcctcctctccagcctctcctgcttaggggttgcgggaggaggaacacagcaccctttgcagtcaggaaagaggaggacacccaggcccaggaatcatagcccccaacatgcagggctggaatcctctcccctggtcctggcttctgcccatgaaagcccacactgccaaggactccccacgggggcagaatccacccaccctgactgcccagagagccctcaggtggtaccctacagattcagggccagctctgctcatgtgctggatgccaagggaattacgtggtctgattcagactggagaaagcaatacaggtgttagagcaagagctcgtgatcacaggcaggctcctcccccaccaaagtggtgccaggcctgtgggtgccaggcctccaaatccctggggctctccctcactccctaggatttccttaccttacccactcttctcttcctggtacctgtactacaggtgggtggtcatcgcctaatcatcctgacctgagagcgagccccaattccagggatctcatatgacttagtcctctggatggggcctcacaggtgctaagccacaaccccaaacacccccccctccgaccaaccctgccaccatggaaagtggtactcccactgaggtggtgccctggtgctgcgtgtggtggtgcaaacttcggtggggccacctggagagctctgccttcaagtctagtgacagtcctgaccacctgctacacgtgaggctatgcacaaggcacagtggctacaagctcaagacccacgggatgaggacaggggtcagaaactctattcatctcagagagataagaagtgaaaccctgaccatctctgagacctgcagaagtgactgcctttctgagcctcagtttcctcacctgtaaacatgatgatggttcctaccacttaggttctgaaaaggattcctatatttactggcatgtaggtgtacaggtattgaaaatctgcaaactggctaggcatgatggctcacacttgtaatcctagcacttcgggaggccaaggtgggaggatcacttgagctcagaagtttaaaaccagcctgggcaacataatgaaacctcatctctataggaaaaaaaaaaaaaaggagaagaaaaaaatctacaaattgccctgtgatgcacaagctacatttcaacagataatcaagcttcaaggacaacaaggactgtgttaatggccgaaaaagctggattgtaaagcaaaaagtatcatgtttgcatgtttgtgcaaacacacaacacatctgtgctactccagcacagtggagtctacaaactgataagaaagagtgtctcgtttgtctatacatgcactgacattctactactgatgaaaagagggcctgacaacgcagaagtcccatggcgtgcagaacacttgcattcaacaggactcggagtgccctttcctaaaccgactcccccatcaagtcacgatgttaccatatagagctgtgtgtcccagcaaacatgctgaagatgacaactctttcatctgttccatgtgtatctgtgcaaggcccacaacaccacatgtgctgttcccaacacggagcatacagatgaaagcaaaacaaagcttctgctcttgtgcaagggatgccaattagggaaagagaccataaacagaaatgcctttaaaacgttatgtcttggccaggcgcggtggctcacacctgtaataccagcactttggggggccgaggcagacagatcacctgaggtcaggagttcaagactagccgggacaacatggcaaaacctcgtctctactacaaaatacaaaaattagccaggagtggtggcaggcgcctgtaatcccagctatttgggaggctaaggcagggagaattgcttgaacctgggaggtggaggttgcagtgagccgggatcacaccattttactccagcctgggtgacagagcgagactctgtgtcaaaaaattaaaaataaaatgaaattaaataaaataaaatgtcttgtgatgaaaaaccaaagccaggctggaagccacagagcaccagtggtgttgtgacttcacactggcaggtcaagaaaagtttctctgaacaggtaacacctatgcagagatctacaggaagaaacacagtgagccatgcagttatctgggaagtgaccaacatgaaggaaacaaatggagaggccctgaggcatcttcaggatagtaacaaaaggggccttccaacatccatgaagcccacagggcagggctggaacacagcagaaaagccagcaagagctggtgagagtcccatttcacagaggcgagccatgtgtgggagctggacccagatgttctaccacctagaccaatgtcctttgacttcacaggctgctatttacgcaagacccctcaggaacaagatgtggcctgcagccctctggaccaccccctcagggcctcacaggctaagattcccaggcaatcctgaccatgtgacttaaagagggcaccctcactcaccatcctccaggcctcggccgcggggcctgggcttgttgcccaccactccagtgcctgcatgcacctcaggggtttcaaatgtggctggagtcacatctaggggaagagagggggataagaattagagtgagcctgaagcgacagttcagcaggctttcccctctccgccacccacagggtcctcatacagggtggcgggggctcccgggacatcttgcccaaggcagagccaaacttgatggcaatctggcgcatccgttccaagtctccattctcctcggcttccaggtactccttctgtgcctggagcttctccacatcaggaaagaaatccctttggatgaccgtctggaggccctgcaaggagagatcagaatgaaagtcagaggccaggcgcggtggctcacacctgtaatcccaacactttgggaggccaagggaggtggatcatgaggtcagaagttcaagaccagcctggccaacatggtgaaacccagtctctactagaaatacaaaaattagccgggcgtggtggcaggcacctgtaattccagctacgtgggaggctgaagcagaagaatcgcttaaactcgggaggcggaggttgcagtgagccaagatcacacccctgcactccagcctgggcgacagagcgagaccgtctcaaaaaaaaaaaaaaaaaagaaaaaagaaagtcggagctgcagtctgggtgctcctgcctcacaggtccactgctgtacatgctaaggaacttgctgaacctccttcaaattctacttccccaatgactggggctggattgagggagcttgagggcactttctagtggggttgagcatcccatatggtagccatgctgcaacctctaacattactaaacactcttctgaagtccgtgaaacccttctctctcgcccttgctaactggtcattctcattctccattgctggctccccacaagccagaccaatgtgggtgttgtcactttcattccacacatgactttctatttccaatctaaacctttctcctggcggggcatggtagctcacgcctgtaatcccagcactttgagaggccaaggcgggcggatcacctgaggtcaggagttcgagaccagcctggccaacatggtgaaaccccaccactactaaaaatacaaaaattagccgggcgtggtggcgggcacctgtagtcacagctactcggcaggctgaggcaggagaatggcttgaacccaggaggcagaggttggttacagtaagccgagatcgcgccactgcactccagcctggacgacgagcgagactccgtctcaaaaaataaaataaaaataaacctttttcctgagtaacttcagccagtcactaccacaagttgagattcccaagtctgcacctccagccagaccttgctcccgagctgcatatctgggcacccaaccgtccgttaaagccatccatctacatatcccaaaaggtgtcccgaattaaacaggtctaaaaccaaactgacttccgccaatccccgtttcagctcctccttctgtgtgcgtgtggtggggcgacgcaggtccactcactcgagatgctgtcacaactgcggtctctttccaggaaccccagcattcacacttgctgccaccgctctttagaaagccctctttgccaccatccttccagtttgtcaaactcctactcacactttaacagaaaatcttctttccctgacccccgtcccatacaaagagagccgctctctcttttccctgacaacactactacagcctcttccaccacagacgtcttcctctgccctgtttacttgactcgtgggaccgtccacacccggctcctccacttccacgaggagacggagtgtcaacacccgagagagggaacctgagaggagcttgaagcagaggatgggcccagaagtcgccggcgtccgcaccgaggtcgtacctcgatatactcttcctcgtccaggacccgctgcttgctcgtcgcagccccagcctctcccgcctcgcgcttcctcgggggcctggacgcggcgggaagcaacaaggacgacgctgatgcgcccggcgtctccatcgctatcccaggaaaaagctcgggcccagcaggcgcg

SEQ ID NO: 1043 - DNA, 86173 bp, Homo sapiens
cctcttccggaacacaagtttatttggcatttggatgaaatgattctcacagcatcttaagaaaagttagtgtcaacccaaccaaaaactaaaaacccttaatgaaaacataaaaaaacaggcatcaagacaatgtacagtatcaaatcccacctccgcatggcaggtcagagggcacctgggctctgagaaaccgtggcaagctggtcctagaggaggaggacccctggagcacaaggttcagcaagggtgaccccgggacttgctggtcagactggggactgcagcaggccttgcaaagggggcattctggatggtggtgcaagaacagatgagcgagtccagctctcctcatgctcccaagggcctcctggagccacagtggcagcggtgttccaggcagccctgccatgtggaccttctgcctggcccaacgtgccagtggcctgagtgcttgtggaggcccatggggaaggggccacccagcaaccccggccagcccaaggcccaccctctgcagcctgcatggtccactttaccccgtttcctcactgccccctacgtgtctgaccggcccctaatgttcctctggtccccaaaggaagcgtcccagtcccacacatctcgtgccagccaccctgtcccgcacacacagttctgaggcctggcaggaatcctctgagctctcaggctcaggcccgtgggggactctgctgcgtggtcctcgggccctcactggccacctggcacccataatgcacatgcctgctgctctggaacctggctgccctgccccagtgcatgtgggatccacggcatgcttcctgcttcgtcctctgcagccagtaggggactcctgtggccaggacttccttgttaagtagcagcccttctccaaggggagcacaagcctgcccgcacacagcctccagcatcatgctccagcaggccaagctcagggacaggcaattcagtaacaaaactcacagctctggacagttctggcacaaaggtcaagtctgtctgtgggcaactcaagattctcattccacatgggatggaaaaaatgggtctccagccacagtgtgagaatgtgtcaagaagtggactgtgcatggagtccatccccgagcagcaccacagaactgcatgcttcagacaggcctcccaggtgctgccccgctggtctggaaagactgagcgagacagcactgcctcagcacagcccaggatgcatcgatgaccctggaagagtgggcccccagtgacccgtgaagttccatgtgccaccctcacctgcagacgcttggccacatacacacacagagacacaaacatacaaaggaaagatccagacattcaacgtagaaaagatatggatgtgctaaaaatcgcacagaacccgcttaatctccaaacctcagaaatgttaaaggccctgtgtcaggcaacaaaaccactgcccaggagcaggcaacagggtccgtcaggcaaaagggtgccaggaagggcccccagcccctgcgctgctgaggaggggccgggaggtgtgcatgcggccgctgggcactgagctgcagtagtggcggtgatgtaaggagtggactttaaggagatagatgcagcccaggatggtggtttcagccacccctcctgcaatgaagcaaccctttatggcacaaatggggccgggggcaggcccaggggcaattcaacaggaggcaagagcccagggctccagagtggagagacaggaggcagctcagtccccagaccccagcagagcatctggggcctcggccccactccagagcttcttcctgagggagccatgcacagcaatgctgggagagggactgatggggtggggtcaggcctcctgccacagagctgggctgcagagcccagatggaaagacacagtgaagagctcaacctccttccaagctctccttctcagggcttcaggttccagagccccaggggagctcccagccaggggcagggtcaccttgatattcacaactgggcttgtgggggccatcttcagtgcaaccgttgtgacaaagtcaagaggctgcctccctgaagcagacccactgcctacgccacactgacggtccagaggccccctcctgagggcggccagcaaggggcactgtggcagctcccactgtgcctgtcccagactgggtcagcaggtctctctggacagcacactgcaccaagtaagcccaccaaaaacgcatcaggtgtggccatggcccacagtaccttcttcattccctgcctctaacatgtgcggtctgaatgaattttgtcactcttctgccatttataaaggagaagacagtgatccaaagctatgcatgtttctgaagccctcaaggaagctcggtgcaggccatcacttcttttggcagaaggcgggctgtggtctctatgtacacacgcgagcccgccagtgacgtgcggcagtgcgtggcgtccaggctgggacaggggcctttcaagtctccccagggaccggtgttttctacaacagacaggtgctcccagaccgttggggtacaggccaggccgtctacaccacagtattgagggagctgcggctgtggcggccaccccctggcagtgcctctgcagctggggtgctcccgctctgggcagggtcagggggcacgagcagggcgctgctgctgtcggcagagtcttccaggtctgccagagaggcccccgcagtgggcagaggctgctccaggcgccggagtaatgcaccttcactcccaccatccccaggggctggcaggctgacctccacaggctcaaaagcatcatcgtctgcaggaagagacagaggggtgtcagaggcaggtacgggcctggcacaggggatgcaggggagctaggcaaaaccaggagacactcctcctgcctgaaggcccccctgaagctgggtggtgagcaggacctgggtggctcccccgggcctcagattttgaaggaggagcctgccccacatgacacctgttgtacctactgccccctgtggctgggaacctggtatatgcaaggtgcagggcccatctcacaaaggcagacacgggcctgtcccaccatcggtgtgaggtaggggagacacactgaccagcagtcactagaacagaggggcccaaagggaaaccgtctcagactcagtaaggtgaagacccggctcagcaagaaggcaggggcatttgtcatcagggaggcactgggcccaggtgggtggaagaacattcagggctgcagctggaatgtggcaaccggagtgtgggcaacagggctgcagtgagcggcctggaaaaccacacaggtgtttgcaggaagctctgatccaaggcaggctgtgtggtaggcagtcgactcgctttgttttgcccgatctttattacttgctttttttttcttttaagagacaggatcttaaaagattgcacactggtgtgcagtgacgtgaccatggctcatgacagccttgaattctgggctcaggtgatcctccattctcagcctgcccagtaactgggactacagctgtgcccactatgcacggctagttctgaattttttgtggagaaggaggtctcacaggctggtctcgaaccaacctgggcaacatagtgagacccctcctcccgcctcagcctcccagagtgctggattacaggtgtgagccactgcgcctgggctgcctgcttgtcattaccataggctgtctctgaaagctaacagcacaaggccccggtgatgcacctccctcccggccagcccctcacagcccccaccctgctctgcagcctggcccacacaggtgtctgggatctgctgccacccaccaccatcccttgcaggaagctggtcctaccctggaagactgtgacaatctgtgtcatgagggcaggggtcaaatgcaagtcttttctgcacccccagatcatgcaagagctgtggcagctgactaaacaaacgaacaggactgagacctttaggcacagcagccccagcctcacaatgcccattctgccgagatgggcaggcatgcaaggagccagccactttggggtggcactgcctaccaaatatactacaggtttgtgtgtgttagggggcctaatgcacagggagatgggatgggacacctgcactgctcaacagagacagagacaggccaggggtcaggggcctgccactccttagctacacagccttgaggaatggcgcccactctcagatgggtggtaggctccaactatgggccagtagcacagaagccacgctttcctcccacctcacagagctgcctcctgacacgacaggaggggctgtcaccatggtgtctctagctcatgtgtctacagacaagtgattggctcctgggtctgggccagccctgtcttcacaaccaccactgtcgggctccccaggtctctagagctgggctgagggccctgagggctgcccagatgacaggtgctcacagaaggcagggaggtaggagggaggggtcccaggccttctcagagctctctgcacagattgccaagggcggccaggcagggagatcaggaccccttctgcacgggcagccccaggagaagccttaaaggaaaaaccaaagacaaagccggaaagaagtgaggtccctaggcctctgcagctgggcaagagtgctgggctcagccccacgtgccaggttacttgacaaggtgttccctctccctggggagtcaggcacctgcagggtcatagaacacactgtccgggtggatggaggcctcgtagggcggcggagggtcgtcgggctggccgatgtccgggtacttgtatgccgtgtagggaggtggagggtcgtggaaatggaaagtcccaccctctccgtcgtcagaaagatgcagcggcgtgaggcccgtgccaaacccgtctgggccgtaatcaaagccagggatcctgcggccgaggttgaagtggtgcactgggccatcaaaagtgtgcaacgggaacagagacaagtcactgggggcaggctgcctggctcctgagccccccacccccaggctgggcctgccgtccctgagtgcacacacctgtgccccgctgcctacccctcggccacattcggcatccccatgagacccctggtgtgctccgtggcatgtctcaccctcaccacaccaacctgtccctctgggctgacacttctgtcagacccagcctctggctgaccacacccctccagctggaagggtgatccgggcctctgaccctcagaggcctccgagttctgcccaccctgtggctcaatgggaataaggagggtcttggcaagaactttcctggcccacaggtgaggacacagaccccacaacatgtggccttcaaacctgcctctgcccctctctgtccagggctggggagctcatggagacatggggtgacctggggtggggatggggaccagggttgtggccctcagagggcacttacagtttgctccaatcagggactcgatgcgctcccggcgccgctggcgcagccggtggaccatgaagagcagcagtgacaggatgaggaaggaggagatgcagctgacgaccaggcgcatcccgctggccatggagtcaaacagactgttgccatctgagggggaggggaggaaatggccgctctgagaagggggccaccctcgtgctacgctggggatgctgtcgtcctcctgcccaggcgggctgtgtggacaaggcacacagtgtctccctgcacccaaccatctttaggatacatgtgaaataaggccgctcaaaatcaagaacatggtgacagcacagaagcagaagagcgaatcccaggtcaggaggagcatctcaccatggccccaggctgctgtgtgccaacacccctctgaccatcaccggagcaaactaggatttcctgtcctaggactagcactcctaggaggctgcgctcatgtgctgtgtaccccaggtgtggctggggagcggccctcctgcagaggtgcacatccttttccaggggccagggctgcacacaggcctcccacgtccgtccaacagcagccttccttttgtctgaggcctgggctcttgggaggaaggtgctcagttgcccagcaagaatgagccagggggcggtgagggacagccctttcctggtaggaggccagggttggccaggtaggcaggggtctcatggatgacagttgctggcagtttggagtgggggtgacgcccctgcggagcatggctcgggcggctgccgtagggaggacaggctgcaagggagtagcatagggcatcaggaagccaggaggaggacctgccgcagcagagaagggaatgacagaggcctggaccgggtagtgacagactgggagaagtgacagtataaggtacacttgggactcggattgccacaactccctgatggactgtgtaggggaacagtgagcccctgtgggcagccgcacggtcaactcaggtatcatttcacaaatgtgcctctgctgtggttgggcgtgaagcctgtcactccaatccttaacaagccatggcagagaaaatgcgcatcccctgacgcacccagccctggcatacacgtgcagatgacacctggacacaacactgggtctcacaggctccccactgagatgctctcccggctcagccacacccacacattgggtacacacgcaccaagcgcaggtgtaggagggctgggtggacccgactccacctctttgctgggtgagtaggcaggaggggccatgaagcttgaagctgagtcccagccaggctagacgccaaggagcactgagtctaagctgctgcgccttcctctgctcttcttcaaccatttcacgcttttcgtgaccaccacttggctgggatgctactagtattcagcaggtggaggccggggtgctgttcaacatcctccaggacagcccccaacacacagtatctggtccaaatgtcaacaccgccaagagggacacaccctgccctggtgcagtgcacactggggacaggggctcgatatgagctgcccatggggaggcagagatgacatgagtggtagcaggcatgaaaggagaatctaccagccacacatctataacatggctggcagttccatgcactcctgacttgggtaaactggcaactcacagaagtcacagaataatggaaccaggaagtggtcccagaagtagcttcctccacagaccaagagtgaaggccagggaggcttcaaaacgaggagtgacccatcagctcctggaagcaggaggaccccacaccagcagggaccctgctaagctaggaatggccactcccacctctgcaacaatctcggcaggcaggacccctactgcctgccccaaggagacacttcacaacccccgtgtgagtggctgggttcccagagccctcaagccattcctgctagcccagtacactccatgcccacacagatggcagcgccagctcctgtcctcctcccacggggccaggaagcatctccaaaagctgcattttttgctgacgacacatgaagtgaatatgtgagaaggatacatcctctcaccaattagctgcttttcctgatgcctctgaccctcctccagtctcaagggcactgtcatcagtgggagaaagcctagtggcccagggactggtgacgtgcctgttcattggaggccagttcagagatcccaggggagctcctaagaaagcagcccctttgcaatgactaactcttaatccgttctaaaataaacccaaggacacggtcaaggtcccaactgtccctccaaggtggggaccggaaataatcatctctcagaaccaagccacttgtagtcaagcacaaagaagagagcctgccccagaagccagaggccagcccaggggccccagaggccccttgatagggctgatctctccatggagttctgggctgtgcagttggggttgtcttttgtctctcagctatcctgcagctcccagagagaggatccagcctgtgcaagaagagctccagtgacaaggagctcaccatttcattgagcttggttaagtggtaacagtttcaaaatctccatcagagacaccatggggagcagaaggtcagcagggatcagaagctgagaccaggaacccaatgtgggctctgtgcctggcagctgcaccagccaaacacctcaccatgcctctgggaacctcatcgtatcagggctgcccgacagcagcagagcaagcaggggcagagggcggcatgagtttcagctgctctgcaccttggccagcacttgatgctatcagtttcattactttagcctttcgagcaggggtggtaccccacgtggatttagtttgtttccctaatggccaatactgagcatcgtttcagctgcctgactgtcatcctatatcttctttgataaagtttaataatttacatcttcttctaaagccatttttcaatagcattgttttgttttcttattattgagtttttatgtattctgaatacagacctttgatctgtgttttgcaaatacttgttttgattcagtcaggggcttattttttcatttccttaacagtgtgttccaaagaacagaagttttcaattttgatgaagccaaatttgtctgttttttttaaggatcatgctaaaaatgttgcctaacccatggtcacaaagatttctctcctatgttttctcctagaagctttataattcaaggttttacagttgtgtctatgaccattttgagtaaattttacatacagtaggagggacagtgtaaggttcgtattttttggcatatggatgtcctgctgtcccagcaccagtggttgaaagactatcctttctccactgaactgctcttgcacctttgtcaaagattaggctggtctgaaggtagtgagtcatctcgattgattgttcacagtcagtaacagatcaaactccttgttgtactcttttcccgttctcacgactgcacttgactcgtcttaaacaaacaaaaacagagagatcacctgattatacgtagtgtgggactatttctggactgttgtgttccactgatctatgtgtctgccccttcatcgataccacactgttgtgattactatggctgtacagtaactcatacattaggtggcatggatcctccaactttgttctttgtaaaaactactttggctattttaattattttgcctttccaccaacttttatctacctttttatttaagagacagggtcttgctatgttagccaggttggtcttgaactcctggcctcaagcaatcctcttgcctcagactcccaaagtactacaattacaggcatgagccgctgaacccagccctattttatttttactttttgagatggagtctcgctctgtcacccaggctggagtacagtggcgtgatctcagctcactgtaacctttacctcccaggttgaagtgattctcctgcctcagcctcctgagtagctggtattataggcataagccaccatacccaactaattttttgtattttttgtagagatggggcttcaccatgttggccatactggtcacaaactcctgatctcaagtgatccaccctccccagcctcccaaagtgctgggattacaggtgcgagacaccatgcctcgctccacctgatttttagaattagcttgtcaatacctacaaaaatgtctgctagaattttggttgggattatactgaatctataatttgggaagagctaacctcctaatgatattgagacacctgatccatgaacatggtatctttccttttatttaagcctttttgtcatcatggttttacagtttgcagcaaacagaatgtgcacatattttatattatttataattgggtatttcattttttttggtgctattattaatggcacttttctcaaaattttcaattttcaactgttacagatagattatataaatatgatgaatttttgttacgttgaccttatatctggagaccttgcttaaacacacttattagttctaataactttcctgtagattccctaggattttctatgcaatcatgtgatctgcaaagggagatggtttcatttcttcccctctggcctggatggtttttcatttcttcttgccttctggcactggctttgacctcaagcacaatgatgacagggtggcaagagtagacactcttagcttgttggaggggacattctgatgcttaacacatgacatcctattcccagagtctccagttttggtgatagtgtctcggttcttgagcactttccagaagaaggccctaggagagtcaggagcccatggaagcatggccacagggcaggcagagcagggcccagctaagtcgctctggccgtgcaggagagagggctgcagctgctctgggcccacccagatgcactaagggccctgctctgctaagaagtccttggggctgggcaggctctttaggccatacatgcccacaaatgggtcatccttgtacacatctgggcattcttacaaagcttggacagagtggcaaggcagcactggtagactcctgagaaatggaaccaggagtccaggtagcatggcttgtgaacagagtttgactcttgtagccagtcactaagctgggggtttaaagttatgtggccgggcacagggaacttgataagcactcaaccagtgcttctcatggccctaaacagacatgcaccctatacgaggagaaactgccctgcagaatggggtccaagcatcaccctctagctctgggtcctctggtgggcttggctgcaaatgtagccttgtgctcaccacagtcaactgcacatgtctgatggtacatgccacagtgcccactttcacccagcctcaggcacagcctctggaggacagctttgtcctcccacccagcagccccccagtgtggagggacactgacaacattccactcaggggcagctttcactgttgtggcccagcctctagctgcagcctctcctccacagggcccctagagacagagatggccatcacaccctgcccaagctgctcttctacaggggccacaagtccaggggcttccaaaagtccccatcatttcattcctactgtggcacccaagaaagaaagaaactcatacttttgatttacatttctcttgagatctgaattcacacagagctgcagctacaccggtgtgcagaatgacaaagcatgcccgtggagtgtgaggggtgttaacatctcagagagcagtggcccacctgctcctctctttttgcaagtggaagggagaggatcaccctgagatcagattccctgtagtgtctaccttaaagcccccgcctggtggtgaggagtctgatctcgaaactgagaataatacttcatctttttctcgaagattctaaggtaaaaatggatgactgtaagcaatgacaactgtcactaccctccatatcatcatactagagaacaggaagagctccaatgtggacataaattagaagtctaggctggacgcggtggctcatgcctgtaatcccagcactttgggaagctgaggtgggtggatcactcgaggccaggagttgaagacctggtctggacaacatggcgaaaccccgtctctactaaaaatacaaaaactagccaggcatggtggcatgcgcctgtagttccagctactggtgaggctgaggcaggagaacggcttaaaccctggaggcgtaagtttgaagacaagtttgaagctgtcagtggtgacttgtgaacaaacagccacacttgagttcaagttcatttgtgaatgctgcctgtcaccccagaatgggaaggaggcagctggaggggtcgtgtcagacacgcccactagagtagtggcatcaaagtctctgagacatctctgtgacaaacgctgccattgctgctgcgcgatgctccataaactctcctgagtcctcaccactgaggaagcaaagggacgcccagcctccagccccaaatagggaggctgacttgggacgtcctatcaagagtctcacctgggtccagacacatgaacttgcagcactctttggggtccttgcggtactgttggcagccctggggcctctcacagagagcagccacacacatctcaggctcccctccatggcaggtgcagctcaggcatgggtcgtcccccttaggggtgaagtagaacccttcatccaccacgttgtccttgatgtcaacacatgtttgacctgcaatgagcatacattgtgtacagatgtatacaatgccaaaaaaggtagcctccccgtgtgggccacactgccaaaaaaggtagcctccccgtgtgggcctgtgaatgctacctgttaccttagaatgggaaggaggcagctggagggggcatgtgagacatgcccactagagtaatggcatcaaagcctctaagacagctctgtgagcaaacactgccatcactgctgcaccacttgacatgagctgaccttccccacctgggcctggggaacgaacaaggcaactgaagacttggccagattgtgctgagagtcttcccagggctggaatgccatggatctctggcccatggcacagggagtggctgtccaagagcagtcactacaacactgttagaacaaagtacatctagccagggcaaatggaggccggagagccaggatggagcacaatgccagactccagggtcactgcagaagtgtttgcctggaagttgctgaagtagattacttatgagattttctcaattctaagatgcagctgctatgagtattaaccatttcaaaatcagaatgtgtgtaaggaagctgccagttctgcttgggaaggcagtccactggacctgaggcacactctgcacagagctgacctaggatgagagtaagaggaatggccatggctaaaaacccagagtcttcaactggtaggcagacgttgcaaatgcctggaggagagacaaggaatgaaggagcctccaagagagccaccctcagtgaaaggcaaagagacatgagaaggtagcttcttacagtctccaaatggggtaaggatgtctagaaaaaagactcttccgaaatttcacaatcacaggtctatgcctcacttaagattgtagtcagctgggcgcggtggctcacacctgtaatcccagcactttgggaggccgaggcaggcagattgcctgaggtcaggagttcaagaccagcctggccaacatggcaaaaccctgtctccactaaaaatacaaaaattagccaagcgtggtggcatgtgcctgtaatcccagctactcaggaggctgaggcatgagaatctcttgaaccccagaggtgtaggttgcagtgagcagagattgtgccactgcactccagcctgggcgacagcatgagactctgtctcaaaaaaaaaaaaaaaaaaagattgggatcaaatctaggtcacccatgtggtcaggaactcccagggcaagatactcacatacaattattccctggctaaaatagagaaaaaagaatgaacagaaatgaacagagctcccagagaaatgtgaaacaccattaagtacaccaacatatgtgaaacaggagtaacaaatggagaggagagagagaaagaggcaaaaaaaaattagtcgaagaactaacagctgcaaactactcaaattcattgaaaaacaataacctatacatccaggaagctcaacaaattccacattcctaggataaatgcaaaggagccacaaactgacacatcagagtgaaaatgctgaaagtgaaagacaaggcgaaaatacgaaaagcagcaaatgggacgtgacttgttacttctaagggaaccccaataagacaaacaactgacttctcagcagaaacaacagaggctggggcagtgggataactgctcacagaaaaccatcaaccaagatccatatccagcaaagatatcttctgaaaaatgaaagtaaaataaactttcccagacaaacaacaagtgagagaagttgtttgcagatccaccttataagaaacactaaaggaagtttttcaggccaaaagtatgcaatccccagatagtaatttgaatacaaataagaaactgaagagcaacagtaaaggcaatcgtgattataaattatagcctacatgcatagttttcctcctttattctcttagctgatttaaaaagcaattgtataaaataatatgtatggaatgtagtattgggtctatgacatacaaaaatataacacacttagatttgccaagaatggcacaaaggtggtgtgtgggagcaaagctatactggactaaagaacttcacctaagtctcacatcttattaaaacactcattcgaaacatgtcctagacttaaatgtaaaacggaaaatgattaaaattttaggaaaaaaacacagaagaaatgtaaggctaggcaaagagtacttggacttgacaccaaaagaataatccataaaaggaagctggtttcagtggctcgcacctgtaatcccagcactttgtgaggccgaggtaggtggatcacctgaggtcaggagtttgagaccagcctggccaacactgtgaaaccctgtctctactaaaaatagaaaaattagccaggcgtggtggctcatgttggtaatcccagctacttgggaaggtgaggcacaagaatcacttgaacccaggaggtggaggttgcagtgagccaagattgcaccacttcactccagcctgggcaacagagtgaaattctgtcacaaaaaaaaaaaaaaaaaaaaaaaaatccacgaaaggagagagaaataactaggacttcattaaaattaagaacttttgttctttgggtaaacttatactgccaggaaaaaacagcaacaacaaaacttttgttcctgaaagctcacctgaagaggatgaaggcaagctacagactagaaaaaatatttgcaaaccacatatctgacaaaggactggtatctagaatacataaagaactctcaaaactccacagtttaaaaaagaacaaaacagatcattagttcacacctgtaatctcaatacaggaggatcacttgagcctaggagttgcgtttgaagccagcctaggcaacatagtgagatcctatctctatagaaaataaaaaacttagccaggcatgacggtgcacacctacagttccagctactcaggagactgaagtgggaggactgcctgagcccgggagctggaggttacagtgaactatgattgcaccactgcgtttgagcctgggtgacagagcaagaccctttctcaaaacaaaacgaacaaacgatgcaaagagaaaacggaagaataatgtgaacaacagagaatatacagatggcaaataagcacatgaaacatgaagaggttttaacatcagtagcctcagggaaatgcaaattgaaaccataaggagccacaggtctacatacatatctgcatacctaacagaagggctaagatgaaaaatagtgaaaacagtaagcgctggggaggatatggagaaattaaatcactcctacgttgaatcactcctacgttgatagtgggactataaaatagtacagccactctggaaaacaatttgcttgtttctttaaaaactaaacctgcaactacgatacaatcaagcaactgtaatcctgggcatctatcacacagaagtgaaaacacatttgcagccaggcgtggtggctcatgcctgtaatcccagcactttgggaggccgatgcaggtggatcatctgagactgggagttcaagaccagcctggtcaacatggtgaaacccatctctactaaaaagacaaaaattagctgggcgtagtggcacatgcctgtaatcccagctactcgggaggctgagacatgcgaatcgcttgaacccaagaggcggaagctgcagtgagccaagactgtgccactgcactccagcctgggcaacagagaaagactctgtctcacacacacacacacacacacacacaaaagaaaaaaagaaaaaagaaaacacgtttgcacaaaaacctgtatgcggatgttcacggcagttttcattgtaatagccaaagactggaaacagcccagatgtccttcaacacttgaggcctatagtttgagaccagcttgggcaacatagcgaaatcccgcctctacaaaaaaaaaaaaaatacaaaaataagttgggcacagtggcatgcacctgtggtcccagttactcgggaggctgaggtgggaggttcacctgagcctgggaggttgaggctgcagtgagcagtgatcacaccactgtactctagggtgacagagaccttgtcgccaaaaagaaaaaaaaaaggaacaaatcattaataaaagtaacaatttggatgactctccagggaattatgagtgaaaaaagccaaccccaaaaggttgcaactatatgattccatttatagaacatttctgcctcatgatgatacctgacaaaggccagaccacatatgaccaaaggcctctgacctaccacttctgtagcaaccagtctagggcagtcaggatctggccagtggccaccagcttctctattttgagtccatacttccaactggaaacccaccagggaaagtcaaatatgttccccaaaccaatcacctccactgccctgcttctagtcaggctgcctctaatcagagcatacctggagcctttagggccctggtgaaaagccactgtgctggacccaactccagctgcaggagggtcagaagcacttgtgaaggctccaccctggatcctcagggcactgggcctgcttaaggctcagatacagttagaacatcagaccctactatcagcatgctaacaagccttgagtcacacagtggactactgctaggcgggctgcaaaagacagactctagagatgtagcccaaagggatgacctcaagtagagggtggagcagacattaagaaaaaccctctggcaaaccagcctccacccagaacaacaatgctgctaaatacgaaagcctgaggtgcactgagggcaactacagtgccaacaaaccccaagcccagcccaactctcgcccagatcaacgccctgcactgtactaaagacctccccacaagaaaggcctagtggaagtaaaggcatagccactgcaagcacaaaactactgaactcagtctctattgtcccacacaagatgtcagagttccaatgaaaagcctagaaaaaagtaccatgctccagagacaaaacaatcaaaaaaccagactcaaatatgacacagatgaaggaacttccccacagggaatttaaaataactacgattaatttgttaaaggctccagtggaaaagctggacaatatacaaggttagatgggaaattcagatgagagatggaatctataagaatcaaatggaaatcctataaataaaaaaacagacaaaatcaatgaaacagatgaagaataccttcaatgggctcataagcagacttgacatagccaaggaaagaattagtaaacctgaggacaggtcaacagaaattactcaaactgaaggactaaaagaatccaagagacatgatgactagatgcaatgcatgattctggacaatgaaaaaaatagctataaaggatattattggaacgactgataaaactggaataatggattgtggattactgtatggtactgtatccatgctaagtgttctgattttgatccatatagtgtgggtacataagaaagtgtccttgttcttaggaaatacacactgaagtataaaacgcttaattaaggtccacagtatcttcagtttactcccaaatgattcagaagaaacatgtagagaaagtgaatgataaagcaaatgcagtaaaactgaaatactgtaactggtgagtctgtgtaaatggtgtatgaaaggaagttccttgtattattctgccttttccataagcttgaaattatacctaaattaacaagttacagaagtctccctcgcctgacccagatggtcctataaggtggttctatcaaacactcaaagacaagtttatctccaacttggacaaatggatttagagaacagtaaaataaaatgtttgccaactcattttagaaaactaatatagtataatacagaaatgagtcaatgtagtcccagctacttgggaggctgaggcaggaggctcacttgagcctaggagttcaagactgtactgtgctatgatcgtgcctgtgattagccactgcattcttgcctgggcaacacagtgatgccccaccttaaaaaaaaaaaaaagagagagtcaaggagagtatagaaaaaaatgtaacaggccaacctcacttcttaaaagagtttcaggccaggcacggtggctcacacctataatcccagcactttgggaggctgaggcaggtggatcacttgaggtcaggagttcaagaccagcgttcaagaccagcctgaccaacatggtgaaacgccatctctactaaaaatacaaaaattagccaggcgtggtggcacatgtctgtaatcccagctactcaggaggctgagacaagagaactgcctgaacccgggaggcagaggttacagtgagctgaaatcacgtcactgcactccagcctgggtgacggggcaagactctgtctcaaaaaacaacaaagagtttcaaaaattctaaatatcagcaaaccaaatccaccaatataatatattatatatatataaaccatgaggatggtttaacataagaaaatccatttatatgaaataatgactgaacagactgaagaaaaactacataaccccaataaaatccactaaaagcatttaataaaaatcagtacacttttgtaacacaaatattcccagcaacctaggaataggtacttctttgacttcatacaggtacattctaaaatcctatagaaggcattctgtagaatattgatacattaaaatagcattctaagttgagaagacaagaatgctcactaccaccatttctaatcatcactgtcctggagactgtagcaagaagagttgactgggcaacatagtgaaaccacatctctaataaatgtaaataaataaataaatgtcaaagatttgaaagaagaaacaaacccatctaaatagaaaatcaacaaaatccacaaactaagagaaccaataaaggagtttagaaaacatatcctaaaattcacatagaaaagggtcaaaaataggcaacataacaggcaagaacaaggcagaggaagtcgtaacaccagcagtcaagatttatcatgaagctctctctgttgccagccacctgggaggagctgccgccccggccgcacatctgcaatggatggtcgcgaggaatcatccggcctgatcaaggggaataagcagacccacagcactgagcctgagaacttaaaggctgcagctccttccactacaacgagctgattcactgcaggactgtgggtgtggacccggcagctgatggcaaaggtgtggtggtggtcatggagtggagatccggccagcagaagccagccacctcctatgaggggaccaccgtcgggtggacacggtggctcacacctgtaatcccaccactttgggagggcgaggtgggcggatcacgaggtcaggagatcgacaccatcctaacactgtgaaacccgcctctactaaaaacacaaaaaattagccgggcgtggtggcaggcacctgtagtcccagctactcaggaagctgaggcaggagaatcgcttcaacctgggaggcggagcttgcagtgagccgagatcacgccactgcactccagcctgggcaacagagcgagactctgtcccaaaaaaaaaaagaaaaagaggaccaccgtcaacaagaacgcctgcaccatgctcggcaacatcacacacatgatccgcaagaacaaagcctctccccaacctgcgcacagctgccatcccagagccagcgccatcctgcgaagccagaagcctgtgatggtgaagaggaaggggacctgccccaccaagagctcctgagacccctgtcccccaaaagcaatagagttagctggctttaataaaaaaaaaaaaacacacacaccatagactggcaaggtaaacagagaagcagagaagcagagagaaggatggcagaaatggggggtggggaggtgacaaacagccttagatgctccagagatgccaagtccttgggtcctcattcccatttactctcttaacaacactgcaacagggaggacagggatgattgtctcttccgtgggaaaagaagctgggctctaagatgcttccgtgggctctaagatgctgaccagctgccctggtcacagagctgcaaatgggccccaagaacaaggtgtgagctggtaaggggcgtccaccgcaacactgcaaatcaggttctgcctccgaaaccttgaactcagggtccaacaaagtgacacaagggcccagacattccccaagaacgccagctcaagggggcttacttcttttacacagaaatgaagacttctcgtagcagctctcggcgtgccagctgtggaggtcgtggtgccgcagggtggggaaatggaagcactgaagctgggcacagaacacgttgtcgttctcagacatggccgaggcaaagatggggtctgggggcaggaacacctctgaagagcctgttggggagacaaaaggtggggctggacaacatcacatcagaggacaagctgtgcagtcctcaaggggaccatggcgtcagacaggatcatcaaccacagggcctggaccgccaagtactggtggtcactgtggccaggtgttcactcgggactccccaacctcctgggagtcaccccaggtgctgggcctagcgggagccactccttggagcctgcaagcacacaggccacaaaccctgggtagcagtaagtgccagcctgagcaccagaagagggtgctggatcacggttagtgggtggcatttaaagttagagcaacagcataataacaaagtaatggattgtggcacactggattaaaatgcaaacaggggaatgggcaagggaaacaggcagggaagctctcccttaggacagcacactcagataaacagaagacttacaaagtccacccaacacccaggagaaaggcgccgtcaggcagcattggcactggccggcactgccagcagctggctgcagggaacacttaggaagcactggctcccggggacctctctcagctcaagggaaactgtcacccactcagctcctgcctaagccaggcacaaggcagtcagaaaccgtgtacccctgccgcagagagcgtgagggttggggactgctaacctccaagcctctcttttgcaaggttccaggtgggctctggccatgcccagggcatggcacagccagccctaggccccactctctcccctgcacggcccttccagtctgggctgccaagattccttgaggcttacccgaccaggatcaatggaaacacaaagcaacctttccaagaagcagaataatgaaggcacacctggtgctctccccctcctaagacagcagcagtgcagctcaccccatttataagcctccagcattctcacctgcgtcttttggagctctgtttatacccagcacgaaacatggggctctgcctcaaaaaagccagtgagtctggaggcaggcctatgctgtgggcctgtggacacatggtgccctgccatgggcaggaggacagctctcaggaagctctgagacctgcaagacctgtgccaggccagcaggcagccacagcaacagctgtgcccccttcccagggacatacaggcccagcatctcgcctgcctcatctgcatctatcagacccacagcagagcaggaaaggggcccactgtctggagtcacctccccataccacctggagggctggtctccactgctgacagtgggtgccaccaccatcacgctgtgcaccaccccacctttcctccaggcccccgagcccctgcacaccctcctcatctcccacagatgccttctcacctaagtagagcccctccccttttaaacactgttttcttcactatttgccttcttgtcccgtggcaagaaaaccaaacaggttccttccaatctttaacaaacaaaaaatcttcagcgctgaagctagttgccagctaagagctcctgcccacaactacagtacatgacagcagactgagaccaaggacacaaatgacctctccgggcagagtcctgggacccagcatttgcccacgaaagctgcctggaccggggcacagcaagtcagagtgagtcaggcaaccagcaaaacagggttcgtgtggcactctaggccagggcccagagagccacacagtgctccctcctggcagcaagctgcatgggcacctgtgtagcgcccctgcccaggggagctgctggtggctctgcatccaggtgctgaatgggggctggtcatgcgggcactgcatgcctacccgaggtgcagccttgcagagcgggcaggtgttcgtctttggagcatccctggaagaggtcacagtggcagccatgaacaaggcagcctgtggggctggagaagaggctggggagtggtaggtgatgagggtagtgaaggaaggggctgctggccttgatggaactgtgatttctatgagaaacgagagctgtgaacaagggagcagaggtgaaaaggacccccagcagctgtgtgaggagcggtggggctggggccaggagaccagacagaggccacgagcacaatcgggtgacggatgattgggtgttagatcccggtgggggctgcaagactggtgccaggtgatgagatcctggacatattccaaaggtgtgagaggagcctggaggcttcccgatactgcactggggatgactcctgcagattttcctccagggcctcccacttcctcctggacacccccttacctcaaacatcccgctcttcctgaaggaccctcatcctagagaaaggccctgtgagcagagctgccctggctaccagagtgactgggagcagttcctcgtgcagagccctcctctcaagcctccctccaagacactactcctcaccccctgccaccccagcagatccagtcctcacctcgacagggtggcggcaagtttccaggtgcccctcccatatgtccacacatgaggtgtgcgcaggactctgacgggagccttgggctgggccgtcaccagccaccggaggacaccctgctccccagactgatacacgagggcatctgaacctgattacctctgccaccacatcctctcccacatgtgcgagcagccactgccacctccatgtccaccgctgctcgccgagcctggagaaccctccccggcccccgagtcccccattgttcgagtggtggggagaccttcactcacttttctgagccctcaaagaacctccccttcctgtctcgccacctccacagccacagaatgagcctccactcgggcccaccaggggctgtccagatgctcccgaatgccccaccacggtggcagctgccccactcagggtctgtctcccctccaagaactgtggcctgaccccagctgaccccatcctagaccaatggtcagctcacccagagggcagggtctctacaatgcaccttccagtggctgctaggccagcctggcccctccctcactgctgactgaggcttctaaacgctaggtcccacaggctggcccaggaccacagccctgactgctggcctcagcgggcaacaccatacaatccctcaggtacagcaccagagaaagaagaagacggagaccataaaggactgggcacaagattttgggggagaaaagaaggcttctactaagtcacacacctcctgacctcagccaacctgcaatgtgcgtgctgagacaccacgggggacaaatgagggccaggcactgagtaatcttaaatgagcaagtgacacaacatgtggacacatgaaacacacgctgttttcacttttatattttaaggtaaatatcaagtatgactcaccagacagaagctacactgctggtgctgacgggaaggccctgggagcagcacgtggggcggtgtggatgattctccctacacaaggatctgtactttttcaacctttctgcacaaatgttacagaaatcctggcctcatgtcttctggcagcagcagcggcagttctgtctccagggcacatcatgacctggtgctgtcaaacctgcagggtcttggcccccaggcggggctcacaggctggtgtgggcctgggggagcgcctggagagcgctccaccaaggcgcacaggaaccctgcggaaacgagctcccaacttcaaatgtgtgtgcagggtaccgacacatgggcatagtaagcgtctatgtaccatggtatcactcacaccccaatctggaacatattatacaacacagaaaagatggacaacatgtagatgaaagaaacatttttcaacatcttaatgtgaggcccttccaccatcattagctgatattctcaggtacaatattttcttagggaagggttcagaatgagtaacaaatgacttacatccatttcccatggttttttgggtatttttgggggggccaacacctcagaccccaatgacccctctgctttgcaccatgtccccaggcaggagaaaggctggggtgggctgggctgggctagacgtgctcttgctagcttgttttatactcagtactgtcttcactctgcagcttgcttttggtacaggaatttttaaaacgattccactatggagagaggagtgcgtgcacccgagccacctcggtgctgaccgcaccctgctgcttggctcctctctgccctaccaccctgggagcccctcccctgcagactccaggatactggctcctaaaaccacacaaccacagtcctattgctgcacctaagaaaatgaatcttccacaagtccccactcatttcttgaattgtcctgtggaagattttataagcctcccaacctaggacaccataagggttcttgtgccacatttggttttatgtttctttaatctctttaagcccagaaccactcatgatgctgagctgcatcaagggccagttatcctgcagcagaagaattattgttattgttactatttgttttgtgaccactatttaaatccgctaacagagttcccgaatccatttaactgggcacaagcaggcagtggcacatggtcacctccgtggagctccgggatgctgtggggccccttgcacgttgagccacacaaatagggagctctatgccagctgcagctgccagcaccaacatacgtgttcaatctttttctaaattttaggttcactctcctgcctgaggctccaatggagtcactgagctgcacttggccattaaagcccacccaggacccttgccattctcacaccaagcatgaggcccccagtccccaactctgaatgtgctgtcatcccactcagaatcatgtcttctcttcaaccaccagtgtcaggaggacaagctaccaggataattatgctctatgaggcaaactttgactctggggcctggaaacccagaagccattgattagtcaatagcaatctaaacaatgcactcataaagccagggaatgcaaatgtggctggggctctcaggagggcactggtggtcatgagaacagggtggcatctgtcctgagcaggatcgggacagcaggtgtggccccagtctgctgggctctgcagcccccacctctgctcctgccctgtcccagcagccaggcatggccccgcctctgtggggccctcttttctccagggaagccggccacccaggccttgacccttttcaaccctgtccccaggcccatcactcctcatttatccttcttagagatacttaagacatcaacagcaggactgggatgtgtttacgaaaagaacccaaatcctagctcaagccacaggcacaaagtacagcccaacagacagggaaggggcagggcaagggagtgtgaccctggcggcagctggagaaggcactgctggagtatgtccaggaggagctcgccagtgccagggcaatgggacaggaagggcaagccaagtccgagcccagggaatgtaaaggaaacagcagccatgtttcctttacgtcgtcttggtatttccaagcagctccgcataaaatctttgcgcacacacacacatgcatgctcactctctctctctctctctctctctctctatctgcctgatagtttccttcaggtctggattctacgtctgacctttgtcctggcaagcttgtcctcccctccagcctgccaggggcacactctgcatgctcatttttatactccaaggtctttaacttcaaaaggaggcgggggacaatctagaaagctggccaaagtgagatgcaacagagggttccagagacagccaccgcccaatgcagggcctgatctgcaggctgcactggccccatgaccgcagccctccctgcaactggggctcacccactccctgcacagcacccctacgggccaggcagcactgggtaagagggaggaggggaggccccgaatcagggtgactctgcccagcttcaaacactcccacacaccagaagggctcacctttgaatgccacctcccagcgaccttccaaggagcggttccggccagtgataacatactgatagccaacccacaacctgcagggcacagagacagagacagagatctcagcggcaggagggatgcaaccatcaatgactgtgtgttttttgttttttgagacagagtctcgctctgtcaccaggatggagtgcagtggtgcgatctcggctcactgcaacttgacttcctggttcaagcaattctcctgcctcagcctcccgagtaggtgggattacaggcacaggccaccacgcccagctaatttttgtatttttttttttttttttagtagagacggggtttcaccatattggccaggatggtctcgatctcctgacctcatgacccacccgcctcggcttcccaaagtgctgggattgttttttaatagctatactgacctccacaacactgagcttctaacatgagacactcatgttagaatgcattaaaattcaaaacaagaaagttcacagggcaggaaaagttttatctcagggaactcttgccaagactgtttctatgagctaaaccggtaaagctttcacaatttaagcaagaacaatcttattcttggtagacatgaaaccccatgaatacaactcggtgactatgctaaaaccataggacagggcactccacaggggagattttcatggcatgtgaactgcatctcaataaagacataagtccctgcaaatatccactaccatgggggctgaaaacacttgcacggcttcccactcagagccagcccacctcaggcctgcagcctgctcctgagcatgcaggcctagcactgaaaggaccttgcactggcatctggctgaccgccataagctcctgcctagtccatgtcccttggcccagctttccagccccaagcctagagatgcccatcagcaggtctccccgcatggcaggagcccagggatggcacactctgccctatgctgtgcaaccacaaggctgtcctcagagatggggctgccctgccctccgggctataccctcttgcttctccactggactcacaggcctgtcctcatggggttagtacaacaacctgtgagctaagagttagtttcctccctttgtagctgcagaaggaaaaacaactccgtcttgtgatttgccaaactctcacagggcataactgtggagtcaaaacccagcttgggtcttgaagcgaaggcccccttgctttcttggggggaacccccacctacactgcacaccccttgcacaaggcccacgaagccccacaccaagcagttctccccacacaagccagcacccccagccccctgcctgcgctcagcaactgcacttgtacaaggagaggggtaccaatgaaaggggctgccccacagtcccacaaagtagcagcagagtccagcctgcccctgctcccaggaccctccacctatctcgatgcacactcctacccatggatctcctgggcttccagtgggcgaggctggtcttcccaacctgctgtctgccagctgtgctccaggagtttactgagtggtcagaggccatgtgctcagtagtcatcagactctgactccagcccctcaggtccccaatccaggactcacttgcgctggtccttccaaccaaagctccgctcgggctggtcccattcctgggccaggacaaagcgcagctcctggtcagtggagaaggtggcgagagagccattcaggcgctggcaggtctgcgcggcatcccagtagttctccccgctcaggtagacccggtagcagctggccgtgccttcgtagtggtgccaccctgtcgggcacttccctaggaaacataaaggacagaaggggagttgtcccccaagttaggatccagctccaaaatggaaattatatgtactccatcagggacaggcacaccttgtaaatcaccctagagaagtggggaaactgaggctcaagaggacaaggtctgcttctgaaaccacattgcagaaatgctcaagtttctctaaaacacagattcaatgatacaagtacattcggtgactcttcccatttctataagatcttttaatttattcactagtcaagaacggctgctgaattaagtcttgtaaagtggatttcattctctgggttaacaacacagcacaactcccatgcagttcactttgggccctgcttccaatgcccagctctcctggcctccgctgccagctagctcactcccctctctcccttttctacttacatgagcatttgcagtaggggctggccaaccctccactaaaacagcagctcaaaggataacagctgggagagccatgacactgtgtgacccgcccctgcctcccacagccgaaaaaaataaggtgtgggcgatgccacaggtggcaaagctaaggagccagccagcacttgagtatcaatgagtctggccagcgtcctctcacttcctccacccatcacttccgactcctacacccacacacgggaatgcctggtaatttacagctcaccttaggtaacaccagtgacctcttttatagaatctttaaccttcaaatgttgggtacctcatattagtacactggagaagagtgacaatttttagcaaagccagttgtaaaattaaaaatgccatttttaaagtgcagctatgtcttgtggcactagtaaaacttctagacacgtatccccatgtatttattatgtaagcatgtgtgtgtgtgacttcttcataaaggcacatagattacagaaaaagaggggcacccctagcccctaagcatggccacagctggacagcaccatctgctcaccgtgaagggtacacctgagtgtgcaaggaagctctttaggtgcagacaaggaatcagagggctggcaacagtggctcacgcctgtaattccagcactttgggaggccgaggtgggcagattgcttgagctcaggagcttgagaccagcctgggcaacatggcgaaaccccctatctaccgaaaatacaaagaattagccaggtgtggtggggcacacctgtagtcccagctacctgggaggctgaggttggaggatcacttgagctcaaaaaggcagagactgcctgcagtgagccaaaagtgcgccactgcactccagcctgggtgacagagtgagaccctgtctgaaaaaaaacaaacaaaaaacaaacaaacaaaaaaaaacaaaacaacaataaaaaatgtcaaggcatcagctctcgagaaggtgtgttgcacattcattgcgtgtttcctgggtgccacaccaatgcatgcagcctgaccacatgccccgcaggtggctctgcaccgtctccatgaagaggtgaggacactgaggcaggcagaggccaggcccctatctcaggcaaggtgagaggaagccctgtagggagggaagctggctgaggcatggagggaaggagacatcccaggatgggagccagctggctggggcatggagggaggaagcactcctgtgcactgactcatcttctttatgttctgaacttggtggagttgcttactacccaggcagaagtgctgcctgttcaaaactgaacagacaggcaaggggaaggaagaacatggagctgagcatcaggaccccctggggctgcactgtgaactgccccttccctacaggtggcctctcagcctcagtgtcttcacacaccaagcctgtgcaccacacttgcactgtggggacccgttcgggctgtgggcacaggccggagacaaagtgcatcaccaggacatgtccagccctgcttcagccgcaccaacatgcgtgaccacctggaaacacctggccccactctggccacccagggttggtgggggttctgccagaagcagacctggtcacctctgaggtgctccccagtgctgaaagtctgggggctgaggagtaacacaagcagacaggcccaaggcagggcagcaggcccatccagtatcagtcctgcctggtccacagccgctgctcagcgtacttgggtacctcgcgcctgagagggtctgctcagggccatttcagtggtggcttttcctcccctcaaccttccttgatgatctcatgcccctttaaaatttcaatgtcataggtaatttattaaataactaatcaccttaaaaatttttcttaaaatggctggacacagtggctcatgcctgtaatcctagcactttgggaggctgaggtgggtggatcacctcaggtcaggagttcgagaccagcctggtcaaggtggtgaaacccggtctctactaaaaatacaaaaattagccgggcgtgatggcacgtgcctgtaatcccagctactcgggaggctaagacaggagaatcacttaacctggaaggcagaggtttcagtaagctgagattatgccactgcactccagcctgggtgacaagcgtgagactccgtctctaaataaataaataaataaataaataaataaataaataaggagtcgagccttcccattttattgctgtatctaaactcagagctggtttcctcatttataaaagggaataatacaactttggaatttccaagggccagtgccttctggccctgaaaagcagtcactttgtgagaacaagcagcctggcctcagagccggttgacttcctagggccttgagtcacataccaccactccagcgctgggtgactgcgggtgggtcatcatgcagcctcattcattcccctcactggcctccaagggctgctttgagaaacccctcacgcagcacagtagtgctggaaaggcaggggtcatgtcaggcttgcactccccagtgtcccagtcagggcaggtctgcaacttactgctgaagcgaacgggctgcgccacgttcaccgcgtggaagtgcgaagggtcgcctcctctggcccgcccctgccgcggatccacagcctccttcccatgatgaggacgcacctccccggtcacttctgaaagcaaaaggagatgtgtgctgtgagtcctgcctgtgcagtcgcagtctccctggccagcatggttcagaccactcagggctgcaaggccggagggggggcctgtagcacagagtccggcaatgcaggctttctttagagccctatgaaacactgccgctcgcatcaaatgggtcccgtgtgcttcttattaaaattatgccgtggcagtttttgttttttaagttactattgtgaaatggaggccctcttcattgcattttctaacaggtcattgctagcacagcaaagggtcctgcataaattaaaatccctcagcagttccagccccatggggatggcccatgaaagagttctctccagagcccaggctgcccctaccccttccttgagggccttctctcccagtatgaaggagacccacgtgtgcaaccttcctctgcagcccttgtcctggggcctgagctgcctatctgtccccctgcctgctggtcccccatggctgtgaaggcctccaggccaggacctcagtatgttcctgtctggctctttggtgcttggcacaggccctggtgtgcagcaggtctcagtgcatggctagaaggtgtcaacaggcagctgaagatgaggaaataactatagttttatacagcatgatctaatagtaatttgcacaccagtgcttccacccacacactctcttttgtcctccaacccccttgtgaaaaaggagaaccacactcctcccatctcacaaggtgaagggcagactcagagaaggggagtgacttacccaaggccatggtgcaggggagagggccctcatgggcccgctcacctcccactctgtacaggtgtaccctgatgtgtcatgaagggcatcgggtacaaggtcaggtcagatgggaaacaaacttggtctgcaaggctgcacacagacagacgcctgccagcaagtgcactctggctgcagatggcgagtggggcctcggctccccaagggaggtcacagggagggttaggaggcctcctgcaaagcctccttccctgaacctgaaccggcagtcagcgccacctgacgagcccctctccagcaggttggttctgctagtgtcatagactttgcaatggtttttatttaataaaaaatccacatgcttttttgctcatgataaagtaacaaacattcaatgtgaaatgcttgaaaaatacaaaagtttgaaaagacaataaacaacaaaggccatatttaactatgcgagcatctgccccctcaccaagtctcttttctacacaaatctttaagaatactgggatcacatcagacactccatttcacgacttgctttgtaagcttaagactataaacagctttctatatttttaaatgggcttaggaacatgacttttgatggctgcatagtattccacaaatggatttctttcatccccataatctctatggtttgaggttaggctgtttgcatttttttcattattctagaaaaggctgccttaaacaccttgtacacaagtgcgtatgtagtctcatttctgagactctggatactcactcagtactcaataagcatagttccatagctcctgtcaggcatgtgatggggatgggttgctattcgactgggaatcactaaaatataaaatatgctacctgtgtccgagacactttcaacagaaagtgaagacctcaaagggagaagcatcttcaaggcttgtgttttttggtagaggtgtctttggggtactttaccaccccaaaatacaacctaaggacctcagtgtgggacagtaactggcaccacgacaggcctgatgctgtaaacacgcagtacttggggaccatcagctctttaggactggtcccatgtcctaagccatgctacctgcagcacccgacactctgggtaggagactcgacccacagactcgctggtagctctgatgcagggatgcagccactaggatggggcatcagcacttggtggagaagggaagagccacctgagcttctgggcctgagactggaagctgagaaagaacagaggggctttctggcagatggagcagctttggcaaagggcaaaggcagacatatccgggataaacctgaggccaggcctgagtgtggctggagaatgtcactgaacttaaattcaacatctccctctgctcaaatgggcaagacctgtggctccactttgtatcctggcctcttccccaagccaagcacagtacctggtaaaattgctcacagaaagacaagatgaactgagggcagaggaaagggaagagaaagaagagataacagagggacagtgctgccaggtcacatgggcaccaaagaccaggttgttacatgttgactgagtgaagtcatctgccccctggggtgggagaccaggtgaaatatttcagaaacataaccagaaagccaaatggtgataaaggacaccactctgttgagcaggcttctctgggtttaggtggcaattgtgagccctttcttttttccatcatgcatctccatatccaaatgctcacattcatcccctcacccccacgtttattcaatgcccattctgggcccaccatggaaacctgccagcacagacacaggcctttgccagcaagaaggggaagggcttggctgtcaagatgatgctgatgtcagacagtgtcctgggggagagtctgggggccaggctggggaatgcgcatagcacaggacagaacccttacagacctctcaggcctgcctctgacagtagagaatgtccctcttcccgcggagggccagcctttggtaagctggggggcctcttccacctccaccagggccatggggcccgagcagccctgcctcacagcccagctggggacctggtgcaggggtcactgtagcacccagagccacatctgctccgactctgggctccatgacctgtgcagctcggagcacatgtgcccctcctgcctccagcaccactagagtgccacgctgctgcttccccagcacaggaacacactggagagcaagttcaacaaggaaacagaatcagggagaatacctagaataccactccacagactatttattcacaaattacttttcgtcacaaaaagggaaagaaatattcacaatagtgatcaaacttaacatcaccaataatgagacaaaatgaccttgggcctcgtgatttgataatttatgacttacatagtattgctacctaaaaaaaaaaagtctcacctgaagctaatcctgaagaaagagacaagtccaaattgaacgccattctacagaactgacctggactcttcaaatatggcaatgtcatgaaagacgcccaaagccccctgcaaaagagggctgggaatacttctagattaaagaacaaagcaatacggcaataacatacttacattaatccttgaataaatcttgaattaaaaggggaaagaaacctgtaaaggatgttctggggataatgaaaagaatctgaatatggattacacagaatagtactacagtaaatttcttgcatgtgaaaaggcttctgtagaggattgttcttattttttgatcatagtatttaggggtagaatatcataatatctgtaacctctcaaagggttcagaagaaaaacacaaagagcaactgcggcaggtgaacccgggtaaaggtgcggcaggacactatcagctggtgaacccgggtaaaggctgcaggagtgtttattgcactatgattatgagttttttatagatctgaaattattcatattaaaaggtgggcgcagggacaaggcaggtggacacacccagattcctcccacaactcaagcagtaaacaaatcaagagttaactggtaagaagataaaacaggtggtgtctgggttaggggacaccagttcagctgaaaatcagggttctttactcagggaagagaggacagattccccatcgccatttttcttccactaagctctcagaaccccaggctccaggcagataggaaatggtcctttatggaaaaaatctgaccaggtcaagaagaaagtccccaacaggaggagattcccaacgaaacatatccagctggttcaccctccagggaagcccacgtgcacagaacttcaagtccctcagccacatacagcagatagggaaggaccaccaaacctctgaggcagagacccaaaccacagaggaaaatagcacagaagaaacaagtacagagacaaaaagttaaaaccaaaaacaggccattaacatcctcaaagtgagaggttctactgtactcatgaaacaagaaaagggtgctattaagaaggagcatggaccgggcacggtgcctcacgcctgtaatcccagcactttgggaggcccgaggtgggcagatcacaaggtaaagagatcaagaccatcctggccaacatggtgaaaccccgtctctaataaaaatgcaaaaaattagctgggcgtggtggcacacacctgtagtcccaactactcgggaggctgaagcaggagaatcacttgaacccgggaggcagaggttgcagtgagtggagatcgcaccactgcattccagcctggcaacagagcaagactctgtctaaaaaataaataaataaaatttttttttaaaaaaaaggaaaatgcagacaacactatccatcattacttgcctctgaaaatgatcttgtacaaatgaacaggaggccaggtgcagtggctcacacctgtaatcccaacactttgggaggctgaggcaggaggattgcttgaggccaggagttggagaccagcctgggcaacacagcaagaccctgtctctatgaaaaataaaaataaaaataattagctgggcatagtggcatatgcctatagtcccagctactcaggaggatgacacaagaggactgtttgagcctagctgtttgaggctacaatgagctatgaccacactagtgcactccagcctgagtgacagtgagacctgtcacacacacaaaaaaaaactgaatacatgacagcaaacatgaaaactcataaaagatttggcagaagttatagaaacctactaaaagtaaaataatcaaagagatggaaaactgcagaggagaaaacgaaaactgggaatcaatccaagagctccaattcccaataataaagagttccagaaaaagggaacagagaagaaaacagaatagaacagagaacaggaaagtgacccctttccctaagctgtaaggcatgagtctaagatgaaaagacccactgaggaggcagtgcaatggttcaaaagatacgcaaaatttccaggaagaaaacaagttatgttcaaagaatcaaaaattatgtcaccagcaacactggtgttggagtaaaaatggagtaagcttaaccttcaaaattatgggaaaaacttatttctagcttatgattctaaaaccagccaaacttatgtgcaaaggtaaaataaggacacttcagacatgcaaacaaggaaacacaaacctttgtctcctatgttccttttccacataagtggggcagtactcgactaaaatgaaggaataaaacaaaacaggaaagatataaaaaccaaacaccagaggttccaacgcaaggagacacaggtgagagtgactgattctcccacactgatggtgaacggggaagctggcccagcagcactgacaggtgaggaccaccaggggcgtctgggaaaggaggggccaaagaactctgactgatagagatctgtaactgaggggacatcaggaaagagacttctaggtacttaaaaagaaaagatatatatgaatctacaggattcacaccaaattggaaaacggcttggcaatttcttaaaaaattaaacatggctcggcacggtggctcacgtctgtaatcccagaactttgggagaccgaggcaggcgatcgcttaaggtcaagagttcgagactagcctggccaacatggtgaaaccctgtctctactaaaaaatacaaaaattagctgggtgtggtggcatgcacctgtaatcccggctactcaggaggctgaggcagaagaatcgattgagcctaggaggttgcagtgagccgagatcgcgccactccactccagcctgggccacagagcaagatgaaaaaaaaaaaaaaaaagtgaaaacacaatgttgtgccaacaaaaaggaaacggagtgctcctgcatggcccagctaggagcagcactgaaagcaggcaagacctcacagagcacagggcccagactcacccaccaggcttagggaagaatcagcagagaatgcctaaaaccacggaatttaaagacacacagataaataccaaatgaaacagctaaaacaatgtttgccttgaaaattagaggggttcatagggtttgctattaaaaaaaagacttacagaatcatttgaatattcaaattgtatgcataagtaacttgaataaagataaaactaaaaatttgaagtagacaatcaaaatcagttcctctacagatctgggatgccccgccccaccttttttttacatcggagctgccgctgaggcatctactgctctgattcctgatccttttattgtgacccaggtttcccgctacaggggttgatgtcctctgcattaccaacgtgctgcagctgcacaaggaggtaattgatacaggcctttttaaaattattgtgccagtcccttccaatccaaggatacaatctttcatttctgggaaattttcttatataacttctttgctaattccctcctcccccatctcctctattttcttttaaggaatttgtattaatcagatattggattttctgaactcatttttaaccacttaagagtgtacagttgggctgggtgcagtggctcacgcctgtaatcccagcactttgggaggctgaggcaggcagatcacaaggtcaggagatcgagaccatcctggctaacacagtgaaaccccatctctactaaaaatacaaaaaattagtcgggcatggtgaaaattagccgggcgtggtggtggacgcctgtagtcccagctacttgggaggctgaggcaggacaatggcgtgaacccgggaggcagagcttgcagtgagccgagatcgtgccactgcactccagcctgggccacagagcaagactctgtctcaaaaaaaaaaaaagagtgtacagttaagtggcattattaagtaccttcacattagttccataacaaccatcaccaccatccatctccagaacttttcatcttaccaaacaaactccgtatccattaaacattacctcccaatttttctctcctcccagcccctggcaaccacaattctacttcctgtatctatgcatttgagtatcttgatagcacatctaaatggaaacatacagtatttgttattttgtgacaggcttatttcactgagcatatcctcaaagtccatccatgctgtagcatgtgtcagaattccttcctttttaaggtaaaccatattccactggatggatagactaccttgttgttgatccattcatctgtgatggacacttgggttgcttccaccttttggctactatgagtaatgctgctatgaacttgggtgtacaaatctctcttcaagtctctgcttccaattctttggagtcgaactgctaagttgtatgataattctacttttattttttgagacagagtcttgctctgtcgcccaagctggagtgcagtggcatgatctcagctcactgcaacctccgtctcccaggctcaagcaactctcctgcctcagtctccccagtagctgaaattaacaggcgtgcgccatgacgcccagctaatttttgtatttttattttatttattttttaaagttcactttattttttgggggggaaggagtcttgtcctgtcacccagactggagtgcagtggcatgatctcagctcactgcaactttcgcctcctgggttcaagtgattctcctgcctcagcctcccaagtagctgggattacaggcatgcatcaccatactcggctaatttttttttatatttttggtagagacggggtttcaccatgttggccaggctgctctagaactcctgacctcaagtgatccgcccgcctcggcctcccaaagtgctgggattacaggcgtgagccaccgcgcccggcaggtaattctacttttaatttgggtggcactgtcatactgttttagtagctgcaccagttcccattcctaacaacaccgcagagggattccactttttctaaatcctcgtcaacacttgtcatttcctgttcaacagcaaacatctaatggctgtgagctatttcactgctgttttgatttgcatttctctaatcattaatgtgcttatcagtcatttgtttatcttctttggagaaatgtctactcaagtcctttgcacattttttttttttttttttttttttgagatggagtctcgctctctctcccagtctggagtgcagtggtgtgatctcggctcactgcaagctccacctccaggattcatgccattctcctgcctcagcctcccgagtagctggaactaaggcgcccgccaccacacctggctaattttttgtgttttttagtagagacggggtttcaccgtgttagccaggatggtctcgatctcctgaccttgtgatccgccggcctcccaaagtgctgtgattacaggcgtgagccgccgcacccagtcctttgcacattttttaaccaggatatttattattattgagctgtgggaattctttttatattttaaatattaacccttaccagatatgagtttcaaatgttttccattctgtaggctgccttttcactctgttgagtgcttcttttaattaatagaagttttaaattttgacgtagcttaatttatctattgtttcttttgttgcctgtgatttaagtgtcttatgtaagaaatcattgccaaatccagtgtcacgaagactttattatgtttttctaagaattttatagtttaaggtcttaaatttaagcctgatccattttgggttaagttttgtatatcattagctaagggtctaactttattcttttgatttgtatgtccagttttcctagcaccattcattctgaaaagacactttttccctcactgaatggtaatggcatccttgtggaaaataatttgaccactgtatgcaaggacttattgctaaggctctgtattctattccattggtctatatgtctgtctttataccaatactacaatgtttggattactgcagctttgtaataaggtttaaagtcaggaattatgaggatttcatatttcttcttctttttcaagactgttctggctctttggagtctgctgagattctatgaacattaggataaatttttctacttcagcaaaaaaaacttgttggcattttaatagggattgaatctgtagattgctttaggtaatagtcacatcttacgttttacagtccatgagcatggaacatctctcaatttatttttgtcttttttttttttttgagacagtgtctcactctgtcacccaggctggagtgcagtggtgcgatctcagcttactgcaatcttcacgttctgggttcaagcaattctcctgcctcagcctcctgagtagctgggactacaggtgcacctcaccacacccagctaagttttgtatttttcaccaagacaaggttttgccatgttggccaggctggtcctgaactcctgacctcaagtgatccacccgccttggcctcccaaaatgctgggattacaggtgtgagctaccacacccagtgtcttctttaatttcttttaacattttgtagttgtcagtgttttcagtctttcatgtgtacttaagaatattctttagtacagacagacccccaacttatgatagtttgactaaaaaatttttcgactttacaataggtttaagacataaatctgttataagttgaggaatatctgtattttattctttgtactattactgtaaatggaattattttcttaatttcctcttcagatagctgagttagtgtacataaatataaatacaactgattttgtgttttgactttgtgccctgcaattttgctgaattcatttattagttctaaccatgtttctgtgaaatctttaaggtttttatatataaaatcatgtcgtcacacatacaaacagggataactttacttctccctttccaattttgatggctttctcttcttgattaattactgtgggcaattaacttcaatactatggtgaataagtggtgaaagcagacatccttgtcttgtctctgatcttagaggaaaagctttcagtctttgaccactgactgattttagtttgctgagacatccttgcattacatttggtccaagccttttgacagactgctaaacttggttaacttggttttgctagtattttgttgaggattttgtatcaatattcacaaaggatattggtctgtaattttctagtagtattactgtctggctttggtatcagggcatgttagagtcacagaatgaattcacttgagaaggactgatgttaattcttctttaaacgtttggagaattcatcagtgaagccatgtggttcaggacttttctttgttgagaggtttttgattactgattcaatctccttattaattatagtcctattcagattttctatttcctcatgattcagtcttggcaggttgtatgtttctaggaatgtgtccgcttcatttaggttaagcaatttgttaatgtacaattcttaacagtattctcttataatcctggcatcaagtaatcctcccaccttgaactcccaaagcactgagatgacagatatgagcccagcccaaaatccaaaactcttgagtgccaacgttgtactcaaaggaaatgctcactggagtgttcaactggtaagtataatgtaaatattccaaaatcagaaaaaaatccaaaatccaaaacacttctggtcccaaacatttcagttaagggatactcaatctgtattttgaatgtggctttttcttgattaggcattttcttagctgggctaagaaacctctgactgttttccagagcttctataaagttattccatctagtccctagttgcttattaatgttttctatggtggaacgagaacctggagcttcctggactgccattttaccaatgtcagaatacatttttttaagttttattacatgaataaagtaactgctaattgagggattactgtgtgctacattcttgtctaatccctttatatgtagcatgtaatgtaatcctcacaacaaccccaagtgacaggcactattattttctccattttatggatgcaatttgcccaaaggatcacagccagtaagtggtgaaagcaggggagcagccccagtccctggctcaagcccccacatttaaccacgatatgacatacagcagagctggctgcctcaggccactttgctgtggcccttctggtctggtgtgctttgttcagactctggcgaatatccacagtggatgttttcttctagatctggtcagcactggttgtctttcatcataagaggaaggtgacccagctagccagaggctctagtgagcctagtgggctagacgcttgtcagggaccacggtgggagagctagtctttcagttggaaaccttccattatgttgacacttttctacctcttgtatgaagtgccagtgtctctagaaaagactcctccaatctcctgtctgggaaaacacctggctgctgacatctggagagcagggcagaagacaggcctgagcatcctacttattacctacttgtcactacagagaatttctcttaattcctctattttcaacctccacgactcccctctgttgtacctggtgtcacttattttgcagactttaagtgctgtctaatagaaacacaatgcaaaccacatttcaacaagtagaaacaaacatgaaattaattttaatactttatctaacccaatatattcaaaatactattactgcaacatggaaacaatataaagaagtattcatgggatgttttacattctttttttgtactaggtctttcctatttggtgtgtattttacacctgctgcacatcttccttcaaaacagccacatgtgactcatggctactacactggacagtgttggtctagaaaatcaactcctgcggggcacagtggctcatgcctgtaatcccagcactttgggaggctgggggcaggattgctagagccccggagttcaagaccagcctcagcaacagggcgagacctcgtctctacaaaaaatttaaaaattagctgggcatggtggtacacgcctgtagtctcagctactcaggaggctgaggtgggaggatcgcttgagtccaggggtttgaggttgcattcagctgtggtttcaccactgtactccaatgggcaacagagcaagactctgtctcaaaaaaaagaaatgaaaccccacatcttatggtagcagaaagagtcacccagtgatggaaagtgaagaagggaatgcgagtgccaagagaattccaccaatccctatcccactcccatgcctatgcctgatgcctgccacccttggcactcagagccttcaagcgctgagcctttctgggaggctgctgggcaaactgcttatttcttgttgttctcactcaagcaggcccatggttgcagctgctctgctacaccaggtcagtttaactctcccattggcttttctttggaaaggaaaaaagctgtataatatgtgaaacatttcaaagaatgtatgtagcacacatgtaagattcataagcctaataatatagttgtgagcgacctccccacaccccatttaggaaatcaagcattattttgcttctcccagtcttatatccctctgtctctccaccaggaactagaattttgtgtatcactgcgcttatttttttcttttagtttaccacatgtgtatgtatctataagtaatataacgatctgttttgcttctctatattgtgccatatgtcgtttttagcaacttgcttttagctgacgttctgttttcaagattcatccatgttgctgcataaacctaacattcacttactgttgctggtgtataacattccatcatgtgagcacagacatttgggttgtttccaagacatgtatcaatggcaaaaattaagatgtctgacaaaaccaagagttggagaggatgtggatggcttggaattttatctgctcctttacacccactctggaaaaactgtacaaacaattctgcaaggatttttccagagtttccctaaatagaaatcctggatcacaggaaataagaatgttcagctttgcaagataatgtctctattccagagtgggtgtaaagaagcacataaaatttccacactatccatatcttctccaacattttaatttttgccagtctaagcatctgtaaagtggtatctcactgtatgtagtcttagaatactaacgaggttaaatttaaatgtctttttctatgtttaatcaccatctacgaaatgctttataggagttctttatatacactgaattagaatccttatcctttacaggctgtaagtgttgcaaatatcttctctctactctagcttgtcttttcacagtctttactggtgttttttggggttttttttgtttttttttttttgaaacagggtctcactctgatgtccagtggtgtaatctcggctcactgcagccttgacctcagggacccaggtgaatcttcccaccttagcctactgagaagctgggactacaagtgtgtaccaccacatctggctaattatttctttttttttttttttttttttttcatagagacaggatttcaccacgttgccctggctggtctggaactcttgggctctggcaatctgcccaccttggtctcccaaagtgctgggattcctggcataagcacctggcctattggtgtctttcaataaacgagagatcttaattttaatctagcaaattcagtcatttttattttagagtgaatattttatgtgattaagaaaaaggtggccagaggctaggtatggtggctcatgcacctgtaatcccagcactttgggaagccgaggcaggcagatcgcctgagatcaggggttcgagcccagcccggccaacatggcaaaaccccgtctctactaaaaatacaaaaattagacgagcgtggtggcagatgcctgtaatcccagctactcgggaggctgaggcaggagaatcacttgaacccaggaggtggaggttgcagtgagctgagatcgcaccactgcactccagcctccagcctgggtgacagagcgaaactccatctccaaaaaaaaacagaaaaaaaaagaaagaaagaaagaaaagaaaaaggtggctgggcgcagtggctcatgcccccgtaatccaggcactctgggaagccgaagcaggcagactgcttaaactcgtgagttagagaccagcctgggcaacgtggcgaaacaccgattctacgaaaacatgcaattagccgggcatggtggtgcacgcttgtagtcctagctactccggagactgaggtaggaggatggcttgagcccaggaggcggaggttgcagtgatacaagaacgtgtcactgcactccagcctgggtgacagagccagaccttgtctcaaaaaaaaaaaaaaagaaaaagaaaaaggcacacttccctatcaaggtcttaaagatagtctcctataatttatccaaaactgaatttcctgtatgttgtgagttagggatccaactgcatccttctccgactgtcacagcactgtgtttgaagagtctgccctttgcacagcgatatgtaattccacctctggaattcaagcttcttaggtctgtttctgacagcttctgtctcactggccaatttggatttccctgagccaattttgaagtaaatcttgatacgggcaaggcaagtgctccctcctcattcctcttcttcacaacgacctctcaatactacgacttaattcttctcaacattttagaatcgacttatcgcatttcacataaaactcacggagctttaaagatgcactgaatccacagaacaatatgagtttttaaaagattcggtcttcctaggcaagaacattctgccactatttacttgtcttctttaatgtctcttaataaaactgcaaatttttctccctcaaaaattttacacatcttttgttaattctcgtttatatcaaagatggttcccctctccctctccctctcccccctccccctccccctctccctctccccacggtctccctctccctctctttccacggtctccctctgatgccgagctgaagctggactgtactgctgccatctcggctcactgcaacctccctgcctgattctcctgcctcagcctgccgagtgcctgcgattgcaggcgcgcgccgccatgcctgactggttttcatattttttttggtggagacggggttttgctgtgttggccgggctagtctccagctcctaaccttgagtgatccgccagcctcggcctcccgaggtgccgggattgcagacggagtctcgttcactcagtgctcaatgttgcccaggccgaagtgcagtggcgtgatctcggctcgctacaacctccacctcccagccgcctgccttggcctcccaaagtgccgagattgcagcctctgcccggccaccaccccgtctgggaagtgaggagtgtctctgcctggccgcccgtcatctgggatgtgaggagcccctctgaccggccgcccagtctgggaagtgaggagcgcctcttccctgtcgccatcccatctaggaagtgaggagtgtctctgcccggccgcccatcatctgagatatggggagcgcctctgccccgccgccccgtctgggatgtgaagagcacctctgcccggccacgaccccgtctgggaggtgaggagcgtctccgccgggccaccccgtctgagaagtgaggagcccctccgcccggcagccgccccgtctgagaagtgaggggcccctttgcccgggagccgccccgtctgagaagtgaggagcccctccgcccggcagccgccccgtctgagaagtgaggagcccctccgcccggcagccaccccgtctgagaagtgaggagcccctccgcccggcagccgccccgtctgggaagtgaggagcgtctccgcccggcagccaccccatccgggagggaggtgggggtcagcccccgcccggccagctgccccgtccgggagggaggtggggggtcagcccccgcccggccagccgccccgtccgggagggaggtggggggtcagcccccgcccggccagccgccccgtccgggaaggaggtgggggggcgcctccgcccggccagccgccccgtccgggaggtggggggcgcctctgcccagccgccccttctgggaagtgaggagcccctctgcccggccaccaccccatctgggaggtgtacccaacagctcattgagaacgggccatgatgacaatggtggttttgtggaatagaaaagggggaaacgtggggaaaagattgagaaatcggatggttgctgtgtctgtgcagaaagaagtagacatgggagacttttcattttgttctgtactaagaaaaattctcctgccttggaaaaaaaaaaaaaaacaaagatggttccactgggaaaacagaaaccatgctaagggatttctaacacgaagggtttaatacagaaaataggtgctttcaaaacaactggcaaggctatatagtgtgagcaaaagtaaagtgggctaactccccatctaattcccacagtcattgtcaagagtcaggaagctactactgccatctataggttaggaaactgcaaaaatctgctgccaatactgcagctgctctgcagccctgagacagctggccagtgggggaaggcagaagccactgcaaaaagtcacctcaaaaatctaagcccatgcacacccccaacatacactatggcctgaggaagaaaggttccacctcccttccacttgccacatttcccaagacacatgtcatagggcaaatgacacacagaagcctgctgccaggtggttctgagtgctactgctccagcattccagcctctgaaacccacggacaagcccagaagggagtgagtgggaaggtactgaatgcccaggctgtacctagcatgtcatttccctcttttcaaaaacatgcagaaattactgatctactgttacatctttcccctttttttgtccctttggttttacattttttatactcctttttagcaggcttttagcagggcaatgaagtaaccccataaggtaactccagaagtcctgaagtctagttcaaaagcaacttgactgagaatggcccagggcttccctaggggttactgaaactctcctcatacaaaggaaggtcacagcttttgagcaagggtggttattagctaactctctacttcccccacaaacacaaagagtttccttttttgagaggggaggaggttgggggaagggagagtgtcaatgaggacttgactctatatctatgattttttaaaaatttcttttaaaataaactagaaaaaaaatcacaagatttagcagtcattaattcaaggaagtaagaaaatacgtattacacattctttgtacatttttatgacttaatttgctcagaatctcaactttaagaacaattagaaatcaacctgcttggccgggcacagtgactcacgcctgtaatcccagcactttgggaggccgaggagagcggatcacaaggtcaggagatcgagacgatcctgactagcacggtgaaaccctgtctctactaaaaatacaaaaaaaattagccgggtgtggtagcaggcgcctgtaatcccagctactcaggaggctgaggcaggagaatggcatgaacccgggaggcagagcttgcagtgagcccagatggcgccactgcactccagcctgggcaacaaagcgagactccatctcaaataaaaaaaaaagaaatcaatctgctcaccctccagactgtgacacagcactatacaaggacaatcataggaccgtgagtcaaggagaagcagggtgagccttgtcagggcagtggcctcctcagcccacccagaacactcctaggccctaccaagcctcagggggcttgcacacacgggtcctcattgtcatgccttcactgctcagccctggtgcaggccaccactcgtaactttcggcttctatgagagattttatttttctgtctagggaaaacatatggcaaccaatgtaacttcaagccaatactcaagtgcaaagttgatgcctgctccatgccaggccatgtggtcaagagaaataaaacctactccttgccttcaacaagtcttcagagcgtggaaagatgaacaaggtggcaactatgagtgtggataccactatgttcagcgtgtgtaacaggacagttattacaaacaactacaaaagcaaagccaaatggcactttgagaacaacaaataaactctgcttccatttgaaagcaaaccaagaatcatctggttctctcttcaggaattctccaagaggctggatataaggtctcactctatgagtcagacaaggggaggctcccactcataaccacatggtcgtccccaggctgaccaaccagggaacttcagcagcccaagcactgggaagcccactgggaatccactttctctgggctttgaccccaaagacccaccagagaggctcccagacaaaggactgtcccagaggctcctgaccgggccaacaccatccaaaccctcatttggaaaggcaaacacctctaccagagacacgcataatctgatgaagaatgggctccagagatgatcaggaggggccccctctaaacagcattcttttctttttttttgaaacagaatctcactctgtcgcccaggctggagcgcactggcatgatctcagctcactgcaacctctacctcctggattcaagtgattctcctgcctcagctgggattacaggtgctcgccaccacgcccagctaatttttgtatttttagtagagatgagatttcacgatgtcagccagactggtctgaaactcctgaccttaagtgatcctgcctgcctcggcctccaaaagtgttgggattataaggcatgagccactgcacctggcttttttttttttttttttgcctttgagacagagtcttgttctgcagcccaggataaagtgcagtggcacaatcttgactcactgcaatctcctcctcccaggttcaagcaattcttgtgcctcagcctcctgagtagctgggattataggtgtgcagcaccacacctggccaatttttgtatttttattagaaacggggtttcactatgttggccaagctgatctcaaactcctggcctaaagcgatccacccacctcagcctcccaaagtgttgggttacaggtgtgagccttcgcaccctgcctaaacagcattctttacaggcaaatacaatctgaccagaccatctctgcttcttattttggaaccccccctcaaagaactaccacaagttcaaatgtcacctaatcccctacctaataccctggttggaatgaattggttttccttcagtactaagcctataggaattacagcacacctttcatgtcctaggccaagtcccactaaggaaggagaaaggtctctgccccctgggaactcatggtctggatggaaaaatcaagcctgggcaccaggaatggtgagaattaccaatggttctgatgctataagagagggacgaatgggggactggaagaagccaatctataaaatgagggaccacagacattctcccactggggtaacatctgagctacaccttgaaggatggtaaggcttgtctatgcagaaacagaacaagagaattccaggaaaacataaaggaagcacacatctacaagattattaatggggtgggcacaagaaacagcccagctgagccactgaaggggaagtagtgataaatcaggttggcaaagcagacctaaaccagcttgtgaaggagtctgcatgtctggccaaagcatttaagcctgtgattctcaagctggggtaagacacactttccccttagtggctttatcagcaccacctagtcttaaaaacgaattcatggatacatgtatatgtatgtctcacacattcacacacacatgcacaagtactcactacacctcccacccaaccaaagttgagaacaacggatccagtgaacattgttattcatggggtgccctgtattccttgagggtgctgaggcagaaaccaggtgaagaacctggttctccgatttagcctttttgtggcctttccatacatctttaggagactacataatggccaggagagaacctgtgagtgcaaagttccaggtgaatgagtgagcaggaggggagggcgtgccaaggccagtctaaaagagcacattcaggatcaagaggcacccacatccagagccaggatggggataaggtcagagaggtggccaaggtgccacccctcaggaggggttcacactcaagatcatccaagtccagggagtgcagcgcctccttaagtggagcctcctgggcatctcacgggcctccccacagccctgccatcttgcaagttctgggatctgcctaggttgggcacttattttttaaaaagacagaaagacagagagagaggaaggggtcggctcaaactaactttccaatgtgttaagacagcacacacctccacccctcacaagaggcacagtcacccagctacaacaaagagacaaggtggtgtgtaccccgcctactcaacacactcacctggacagttggcttcgtcgctctcatcctcgcaagtcgcccagccgtcacactgccaggggagggggatgcactggatggtgccgctgcgacacgcaaactgcccagggttgcaccgcagctctgtgggaccaaagggtgagaggccattgaggaagtggcagtaggccagcaaaccatagcccatgggctggatcaatctcttcccatttgtttgtttgtttgtttttgagacagagtctcattctgtcacccaggctggagtgccagtggtgcagtctcagctcactgcaaccttcaccttccgtgttcaagcaattcttgtccctcagcctcctgagtagctggaattacaagcatgtgtcatcatgcctagctaatttttatatttttagtagagacggggttttgccatgttggccaggctggtcttgaactcctggcctcaagtgatctgcctgcctcggcctcccgaagtgccaggattacaggcatgtaccactgtgcctggcccccatctgtttttaaaatcaggttttatcagaacacagccacaaatatgtattgtctatggctgctttcaagctacagcagccgagctgagtagctgcagaaaagactatatggcctgcaaagctgaaaacatttaatgcctggccctttacgaacctattacctagagataaaaactgtaacacttaagatgaaaagtacgctgcagaacattaacaggttagattttgtagtagaaaagattagtgacttgaagatataataatagaaacactctgaactaaaacacagaatgaaaaaataccaggaaaaaatgtgcaaatcatcagtaagctgtggaacaacctcacacaccctaatacatgggggaacagacacaacatctgaagaaacaatggggaaaatttcccaatttgatgaaaactataaacccacaaatccaggtagctcaatgaaccacaagcaccagaaatacaaacaatacaattccaagtcacattggaattgatttgcttaaaatcagcgataaaatcctaaaagcaggcagaaaaagaagacatgcacagaaaaacaaagatctagatgacagcagatttctcattagaaacgatacagcctagaagacagtgatgtgacatgttaaagttctgaaagaaaaagctgttgacctacaattatttaaagcaaacacacagatactgtattgtgcagtttatagcatacacagaagtaaaattttgacaatagtagcaccaaaggtgggaagagagaaacagaagcacactgttttaaggctctcaaactacaggtaaagtggtccatcacttgaaggtagtctatgataagttaatgatgaacccgactaaaataacacaagagttgtggcaagtaagccaacatagaagagaataaaaaataatccaaaagaaggaaaaaaaaaagacaaacagatggtacaaatgaaaacaaagggtaatatggtagattttaattaaacttgcctaatcaataaatacgcagaacgatctaaacactccaactgaaaggcagaatttgtcatgtagggaaaaaatcaagatacaactacatattacctaaaacaaactcactttatataggcataaataagagaaaataaaagaataaaaaagatataccatgttaacactaatcaaaggatagctggaagggcaggtacatggctcattcctgtcatctccataatcccagcattttgggaggctgatgcagaaggatcacttgagcccaggagttcaggaccagcctgagcaacatggcaaaatgccatctctctaaaaatacaaaaaattagccgggtattgggacaaacgcctatagtcccagctactcgagaggctgaggtgggaggatcacctgagcctggaaagttaaggctgcagtgagctataatcgtgctactgcactacagcctgggcaacaggagtgagactctgtctcaaaaaaaggctagctggagtgtattaatatcacacaaagtagacttcagtgcaaatattaccaggaataaagaaggtcatttaataatgataaagggattgattcaagaggacataatcctaaatgtttatgtatctattaaaatttacaaaagaaacttcaaaattcatgaaacagaaactactgtaactgctaatagacgaatccacaattaaagtcagagcttttaataaccctcttgatagaccaagcagatagaaaaccagcaagggctgggcgtggtggctcatgcctgtaatcccagcattctgggaggctgaggcaggcagatcacttgaggtcaggagttcgagaccagcctggccaacatggtgaatggacaggagttcgagaccagcctggccaacatggtgaatactaaaatacaaaaattagttgggtgtggtgatgcacgcctgtaatcccagcaacgtgggaggctgaggcaggagaatcgcttgaacctgaaaaaaaaggaaattacaaaagaagagcaaatgaaacccagcagtaagaaataataaagatgagagtggacattactgaaattgaaaacagaaaaatagagaaaataagaaaaacaaaagttgtttttttgagatcagtaatattaataaacctctagacagtctgatcagcaaaaaaaaataaagaatacaaaataccaggccaggcatggtggctcacacctgtaatcccaacactttgggagatgatccagcagatcatctgaggtcaggagttcgagaccagcctggccaacatggcgaaaccctgtctactaaaaatacaaaaattagccaggtgtggtggcacatgcctgtggtcccagctactcaggaggctaaggcaggagaatcgcttgaacctgggaggcagaggttacaggaagccaagattacacaactgcactgcagcctgggcgacagaacgagactccatcttaaaaaaaaaaaaatactactatcagaagagagatgtcatcactgtggattccagagaaagtataaaggctaacagaggagtgaagaataaggtaatagtatgaaaaactttatgtcaataaatctgacaatttggatgaaatacacaaattctttgaaagatgaaatgcaaagttcactccaaaataaataaacaatctgaacagccctaaaaggaattgaatttttagttaaaaatcttcaaaggaaactccaggcacaaatagcttcaatggaaaattcctccaaatatttaaggaagaattgatgtcaattctatacaaactctactgtaagttcaggtatttaaaaattaccattaacaatagtatcaaaaaataagaaatacttaggtataaatctaacaaaagatgtgaagtcctgtacactgaaaaattttcaacattgctgagaaaaaacattttttaaagacctaggtgcaaaggcagctccctgaagaaagaacaggcctttcaacagaatggtactgcgaaacacggaagaaagaaaaatgaagaggaggaggaggaggaaagaaaggaagaaggaaggaaggagttcatctacaaaatgaagttaaaaaaaggaggaggaagaggaggaagaaagaagagaagaaggaggaggaggaggaagaaagaggaacaaagaacaactactttgatccattccttgaaccgcataaaaaattcagaatagccaggcccagtggctcatgcctgtaatcccagcactttcggagcctgaggcgggtagatcacctgaggtcgggagctccgaaccagcctgaccaacaaggtgaaaccctgtctctactaaaaatacaaaattagccaggcatggtggtgcatgcctgtaatcccagctactcgggaggctgaggcaggagaatcgcttgaatctgggaggcggaggttgtggtgagccgagatagtgccattgcactccagcctgggcaacaagagtgaaactccacctcgaaaaaaaaaaaaaaaaatcaaaatcgatcataggcctacaggtgaagcctaaaactataaaactcaagagaagaaaacacaagaagaaaatcttcgcacccttggtttaagcaaatacctttaatatatctaccaaaaacacaatctataaaaaaaattgataaattggacttcatcaaaattgagaacttttgtttttcaaaagacatgttaagataatgcatagacaaaccacacacagagagaaaacatttgcaaatcatgtatctgataaagggcttgcttgtaaccagaatatataaagcatgctcaaatttcaataagaaaacaacccaattttttaaatgggcatgggccaagtgcaatggcttatacctgtaatcccaacactttaggaggccaaggtgggagcaacacttgagcccaggagttcaaaaccagcctgtgcaacataacaagacctcatctctacattacaaaaaaaaaacaaaaaaattagctgggcttggtgacacatgcctgtagtcccagctactcaggaggctgaggcaagaggactgcctaagcctaggagttggaggctgtggtgaactaggattgcaatgctgcactccagcttaggcaacagcaagacctccccaactctaaaaaaaaataataaataaaataggcaaaagatcttaatggtcacttaaccaaggaagatatatacagatggctagcaagcacatgaaaagatgctcaacgtctagtcattaaggaaatgcaaattaaagcatgaaaaggtggggcacggcggcccatgcctgtgatcccaacactttgggaggctgaggtgggtggatcacctgaggttaagagtttgagaccagcctggccaacatgatgaaaccccatctctaccaaaaacgcaaaaattagatgggtgcggtggcgggcgcctgtaatcccagctattcaggaggctgaggcagaattgcttgaacccaggagacagaggttgcagtgagccaagattgcaccactgcactccagtctgggcgacagaatgagactccgtctcaacaaacaaaaacaaaaacaaaaaaccatgaagagaaaccacttactagaatggctaaaatgaaaaagaatgaccataccaagtggtggcaagtgtgtgaagcaactggaactctcccagtgaaaatgtaaatggtacaacttctttggaaaacaatttgacagtttctttaaaaactgaatgtatacctaccatataatctgaccattccattcctaggtatttaaccaagagaaatgaaagcatatgtccacacaaagacttgttcatagtacttttatttgtaatatccaaaagctggaaacaaacagtgtctatcaagaagcaaattggtaagttgtgtacagccatacaatggaatactactcagcaataaaaaggaataagctattaacacattccgcagcatggatgaatctcaaaataattatattgagtgaagaagccagtatgtactcaaaagaatacctactgtatgacaacatttatataaaaatctaaaaaatgcacttgcagctatcaagacagaaagggatgggggtgggagggattacaaaggagcacgagaaaatgtttggggtgacgatacgctgtgtttgttatcttgactgtggtgacggtttcacagatttatacatatatgaaaactcaaatttggccgtgtgcagaggctcacgcctataatcccagcactttgggaggctgaggtgaatggatcacctgaggtcgggagttcgagaccagcctgaccaacatggaaaaaccccatctctactaaaaatacaaaattagccaggcgtggtggtgcatgcctataatcccagctattcaggaggctgaggcaggagaatcgcttgaacttgggaggcagaggttgcagtgagtcgaaatcacgccactgctcttcagcctaggcaacaagagcaaaattctgtctcaaaaaaacaaaaaacttggccaggcgcggtggctcacacctgtaatcccagcactttgggagaccgaggcaggcaaatcatgaagtcaggagatgaagaccatcctggctaacacggtgaaaccccgtctctactgaaaatacaaaaaattagccgggcgtggtggcgggcgcctgtagtcccagctactcgggaggctgaggcagaagaatggcgtgaacccaggaagcagagctggcagtgagcccagatcgcgccactgccctccagcctgggcaacagcgcaagactccgtctcaaaaaaaaaaaaaaaaacaactcaaattttacactttatgtatcatttattataagtcaattatacctcaataaggctttttttaactatcatgaaatagatttctgtttaaaaaatcaggaaacaattttgagatcaaaagatactgaccacaaggctaaaaatccaggcaccctgtgttctaggactagatatgcctggaactgaagaactaaattgaatcatggcccacctaacgtgcttgcttctctggaaaagacagccttggcctaccagatctcacccccgccatccatacaggagctaggtccttttcataattataaatccagggcttgccccatgactggtactgaagcactatttgatgagtaaatcagcaattgggacatgctcttctggcctaatgtctgtcttcctcagccacaattaaccattagaccaagaacctggaaccctccattcctcctcagtgtattctaggtcttcagttttattaaaaatttctaacttcttattattttgccataaaaatggaacatgaatggaactggaggacattatgttaagtgaaataagccaggcacagaaagacaaacttcacatgttctcattcatatgtgggagcttaaaaaaagttaaactcatggagctagagagtggagtagtggttaccagaggctgggaaaggcagaggtgagaaaaagaggttggttaataggtacaaaaacacagttaactatagttaataatggtttattctatacttcaaaataactaaatgagtagaatcagaatgttcctaacacaagaaaagttacaaatgcttgaagtgacagataccccaattaccatgatttgatcattacacattctatgcttgtatcaaaatatcatatataccccacacatgtaactactgtgtccataaagttaacaaaaaatttttttaaagactaatgcaggaaaaaggaaaaaaaaagccttctaatttcccaaactatactgagaaagagttcattcactgaatagagatttagcaacagaacattcttttttattttttagagatggggtcttactatgttgcccaggccagagtgcagtggtggctattcacaggcacaatcatggtgcctcaaagtcaaatgactctcccacctcagactacaggcctgagctaccccgcccagcagaatattttaacagtgtccattctattaaaaaaaaaaacaaaaaaaaaaaacaccctatggtgttgttcaaagtaaattcatagctcatgtcacagccctccaaatctacgccctaacatatcataccctaggcccagaaaaacttcaatgcactaccttaaattatttttggaaatagttgagtaagaagtaataagtaacaacactgggggttttctttctccatacccctatatcctccaaaagcaaacgtcagccaagtcttctctggcaaacaaggccccttcccccatgcaccacatccaccttgccttgccttggctgcttctaagtagtacttgtcactcctggcttcctatatatcagtatatagtaaacctatatatatatatacatatatagatatgtaagtgaaacagccaggtgcagtggctcacgcctgtaatcccagcactttgggaagccgaggcgggtggatcacaaggtcaggagttcaagaccagcctggccaagatgttgaaacctcgtctctactaaaaacacaaaaattagccaggtgtggtgcgggtgcctgtaatcccagctactctggaggctgaggcagagaactgctcgaatccgggaggcggaagctgcagtaagctgagattgcaccactgcactccagcctgggcgacagagcaaggctctgtctcgaaaaaaaaagtaaagcttcctgagggcacaggtcatgtctgcactgttcactcctgtgttcccagggcatagccgaccacacttagtgtccataactcaaacacacttgaagaatacttcttctctccatactctatgcatgtctgggaaaggctccaaaggcccaaacagccttcctctttgagaagtgcccatctggccactccatgagtgccacctgccctgccccaggctgggccaatgagaagagtctgtaaggtgatgggagtgggaagatccaggctagccagactgagacagtcacttgaagttctgtgcaccctgaggcagaaagaggtaagggctaagaccagaagggctgagaaaggggagcaacacccttcacagtcccatgaccccaaggatggctgtgcttcctccctgggctcagggaaaagttcctcctacagctactccttacaaccagacagctctggctaaaatagcccccacacggattttctgtccttttctttctttctccagacttttaaaaaaaaaatagttatcaaaagaggaaaaataagctatcagcagaatgactgtcttgctacatcctgaacacagctgggctccccactgctgggccttagtccatggcatcccctctccccaggtctcaagacacaccactctccaggaacccctccccaaactcccctaactgagtcggccttcttggcctagccctgttttcctaagcagcccttctctgttcttttcttcacaccctgagtagggtcagcacacttttccttcaagggccagatgataagtatttccaggtggccagcttcacaggccaccctctctctgccacagctgctcaaccctgctgccgtggagctaaagcagctgcagataatatgggaatgcgtgggcataggcatgtccaataaagctttagcgaaaaacaaaaaaaaacagtggccagttgcaggtatagtttgccaaaccctgttctcgagtatacatatagggacattttacatacatgtaaatgttttgttttttgagacagggtctcgctctgtcacccaggctggaatgcagcggcatgaccacagattactgcagcgtagacaccctgggctccagtgatcctcttgccccagactcccaagtagctgggactacaggcacataccaccatactcagctaattttttattttttatttttagtaaagacaaggtcttgctatgttgcccaggctggtctcgaactcctgagctcaagcaatcttctcaccttatgctctcaaagttttgggattacaggcatgagccactgtgtctggctgagggacacatctttattgctgccccatactccatgtcaccaacaccccacacatggaggcatgcactaaatgcctaatgaactgcacagctcaaaatcttcccatattctgctagcagacaatgaagtgtcagaagttctccaatagggaaggtttttctcccttcttgatccatctgtcaagccgggtctattctggaagcaactgaagatgtggatcactcattaacactggcacctactctgtgccaggcagttctccaggtgacagggctgtggtaatgaacaaagaaagtcaattccaggacatgacagagcttgcatccagcacagcacaccagatggtgactccaacaggtcaaactggcattgctttagctggacatcaacactgcgtttccactgactacgcgtggtgactcacgcctgttaccccaacactttgggaggccaaggcaggtagattacttaagcccaggagttcgagaccagcctggccaacatggtgaaatcccagctctactaaaaatacaaaacataagccagatgtggtggtgtgcatgcctgtagtcccagctactcaggaggctgaggtgggagaatcacctcagcctgagaagtcaagactgcagtgagtcacgatcacaccactgtactccaacctgtctcaaaaaaacaaaacaccaccaccaacaaaaaattgcctgtcctttctcaatatcctccacagtctctctgtaaagcagtaagtgcaacttctgccacatacaaagttgcttaaaaacagtcacccttggccaggcgtggtggctcacgcctgtaatcccagcactttgggaggccaaggcacgtggatcacaaggtcaggagttcaagaccagcctggccaagatggtgaaaccttgactctactaaaaatacaaaaaaattagctgggcatggtggcacatgtctgtaatcccagctactctggaggctgaggcagagaatttcttaaacccaggaggcagaggttgcagtgagccgagattgtaccactgcactccagcctggacgacagagcaagattctgtctttaaaaaaaaaaaagtcacccttgacccagtatggtggctcatgcctataatcccagcactttgggaggccaaggtaggaggatcacttgaggctaggagtttgagaccagcctggacaaggcgaaaccctgtccctactaaaatacaaacattagctggacgtggtggcacacacctgtaatcccagctactcggaaggctgagacacaagaatcgcttgaaccggggaggcgaggttgcagtgagccaagatcacgctactgcactccagcctgtacaacagaacaagactctgtctcaaaaaaaagaaaaagaaagtcaccccttttcactgatggctttacaaggtcctgtcccaggccttctggtgatgactgtcaccttgctgtagcatggcagaggcaggccagctcctcttagccaatggattgttgacactttatgaaacaatccatgcccacaacataccagccacagtaccaacataaggacagccccatcctggctaacatggtgaaaccccgtctctactaaaaacacaaaaaaattagccggacgtggtggtgggtgcctgtggtcccagctactcgggaggctgaggcaggagaatcgcttgaatccgggagacggaggttgcagtgagccaagatcgtgccactgcactccagcctgggcgacagagcgagactccgtttaaaaaaaaaaaaaaacctgccacatcagcagttcctagacttcttcattctaagacaccttaatacacttaaaattattgaagaccccaaagagcttttatttatgtgggttatatctgtcaatatttactgtatcagaaattaaaactgagaaatttggccagacatagtggttcacgtctgtaaccccagcactttgggaggccaaggtggtcggaacacttgaggtcaggagttcaagaccagcctggccaacatgatgaaaccctgtatctaccaaaaaatacaaaaatcagccgggcgtggtggcacgctcctgtagtcccagctactcgggaggctgaagtgggagaaccacttgaacctcggaggtggatggtcctttgcagtgagccgagactgcgccattgtactccagcctgggcatcacagcgaaaccctgtctcaaaaaaaacacttgagaattttttgaacacaagaatctgaagcacctgctcaaaggttttaaccttttaatagaattatcaaatgctcacgattccactcataggcatgtactcaagagaattaaaagcagagactcaaacagatgctggcacaccactgttcccaacagcattattcatactagccaagaggcagagacaacccaagtggccatgacagatgggaggataaataaatgtggtatagctctacaaaagaatattattccaccataaaaacaggaggcatgtagtaccccatgggcaaccaagtaatggtgtattgtgtcgcttcaaaagtaaatgtggggcctggcatggtggctcatgcctgtaatcccagcactttgggaggccgaggtgggcggatcacctgaggtcaagagttcaagaccaccctggccaacacggtgaaaccccgtctctaccaaaagtacaaaagttagctgggcgtggtggcgcacacctgtagttccaactacttgggaggctgaggcacaagaatcacttgaaccagggagatggaggttgcagtgagccaaggtcacgccattgcactccagcctgggcaacaggagcaaaactgttaaaaaaaaaaaaaaaaaaagtgaatgtgggccaggcatggtggctcaccacactcgtcagtaatcctagaactttgggaggccgaggcaggtggattacttgaggccaggagctcaaggtcagcctagccaacatagtgaaactccgtgtctactaaaaatacaaaaattagctgggtatggtggcacacgcctgtaatcccagctacttgggaggctgaggcacaagaattgtttgaacctgggaagcagaggttgcagtgagccgagatcgcatcactatactccagcctgggtgaaagagtgagacaaaaaataaaaaacaaaagtgaatgtgatcagccatcagccataaaaaggaagaaaattctgacacatgctacaacatgaatgaacctggacaacattatgctaagtgaaagaagacagacacaaaagaggcaaatagtatatgatttcactcataagaagtacctacagtagtcaatttaataaggatggaaagtagaatggtggttgccaaggactaggggtgaggagaatagggagtattgtctaatgggtatagtttctgtttggattgacaaaaaagttctggaagtgggtaatggtgctcgttccataacattctgcatgttcttagcactgctgaattaaccgtacacttaaaaatggttaaaatggggccgggcgtggtggctcacgcctgtaatcccagcactttgggaggctgaggtgggtggatcatgaggtcaggcgatcaagaccatcctggctaacacggtgaaatcccatctctactaaaaatacaaaaaattagccgggcatggtggcgggcacctgtagtcccagctactcaggaggctgaggcaggagaatggcgtgaacctgggaggtggagcttgcagtgagccaagactgcaccactgtactccagcctgggtgacagagcgagactccgtctcaaaaaaaaaaaggttaaaatggggctgggcatggtggctaatgcctgtaatcgcagaactttgggaggctgagacaggaagatcgcttgaagccaggagtttgagaccaccccagacaacatagtgagacctcatctccacaaaaaatagaaaaatttgccagacacggtggcatgcacctatggtcctagctactccggaggctgagataggaggatcacttgagcccaggaggtcagggctgcagtgagttatgatttgattgcaccactgcactctagccttgacaacagagtgagaccctgtctctaaaaaagataatatggtaaattttatgttacatatatcttaccacaatttaaaaaagaaatgaaatactaacacatgctataacatggatgaactgcgaaaacataatgctaagtgaaagaagccagacacaaaggacaacatattgtatgattccattagtatgaaatatctagaatgggcaaatctatacagacagaaattgccaaaggctgtgggcaggggaattggggagttactgtttaaaaagtatagagttaccgtttgggatgataaaaaaaaaaaaaagttctggaaatgggtagtggtgctggctgcacaacattctgaatgttcttaatgccactgaattgtgtacttaaaactggtaaattgtatgtgtattttaccacaataaaaaaagttcttttttttttttttttttttttttttttttttgagccggagtctcgctctgtcacccaggctggagtgcagtggcaagatctcggcttactgcaagctccgcctcccgggttcatgcccttctcctgcctcagcctcccgagtagctgagattaggcgcgcaccatcacgcccggctaattttttgtatttttagtggagacagggtttcactgtgttagccaggatggtcttgatctcctgacctcgtgatccacctgcctcggcctcctaaagtgttgggattacaggcgtgagccaccgtgcccggccaaaaaaattcttaaaaaaaaaaaaaaaaaaaaaaaaggccaggtgcggtggctcatgcctataatcccagcactttgagaagccaaggtgggagggtcacttgagtccaagaattcaagaccagcctgggcaacatagccagaccctgactctacaaataaaataaaataaaaattttattttttattttattatgaggtgagagtacctcttgaacccaggagttcaaggttacagtgagctatgacccagccactgcaatccatcctgggcaacacagtgaggcactgttctttcaaaagagagagagaaaaaaagagagaatcccaagcatacatcccattagctgtcagagcaatgatgtcatcacatatcaaatagtgtctggaaatgctaccttatgcttgtgaggatgagagaaaggcaaatgacacctcagtattatcatgaaaacagttttgacctcacggagcccctagaagggtcagggaacccccagagacccctgggcacacttggagagctactgctttgggctatgcaacgcccaggaattagtggattcatgccctgtagaaacccacgagtctctgcaatacaaattctttctctagattcaatttctcctttgtcagcaagccttagccttgtttcaaggctgtctcaaactgagctgtctcaaattactgtgtgaaatttagtatgctgcataaattgtttagaattgatttctcttcaacatttgcccacaaagaacaagagggagacagagtactagcagaagcacacatgtccacagttacatcactaagaaaatcaaaacatttccagcaaagaaatgcaggagaaattccagcccatctgctcgcactactcacagcccactaagataggtctccaccagagcagtctgagacccatcagacacagactcccacacccggggtaggggacacccatgccctgctggagtgcccagaacagaaggttccagcatccctggcaggcctgctcacacctggcagtaaagccttactgcacattctgtcttggaaagagctggcagctgcttcccagtggggctttcccacaggtcatttcaccttccatacaagttgctactaggaaagggagatttgtccagcacacttcaaagcagcagcagcagcagaggggagaaggtttggaagccaagggctggctgggctattgtaacaggcgaccacgcatctccaggagaccagaggtgtggatgctgggttctgccctgggccagccatctcttctccagatgccctcaagaagggacagagggccgggcacggtggctcatgcctgtaatcccagcactttgagaggctaaggcgggtggatcaccggaggccaggaattcaagaccagcctggacagcatggcaaagccccatctctactaaaaatacaaaaattagctgggcgtggtggcgcacacctgtagtctcagctacttgggaggctgaggtggggagaattgcttgaacctgggaggcagaggttgcagtgagccaagatcatacaactgcactccagcctgggtgacagcatgagactccatctcaaaaactaaaaaaatagggaggacagagaccactgttgatagcacaactaaaagacaaaacagagggcatattgctcggtgaccttctaaatggaggggtcacctctgtcctgaggcaagagtgaataataagggccttgaatggggcctcagagatggccagcatctgagccaccaggggccatgggcaggcctctggcaagcacccattctgaacaggtgctgcccagtggggaagggagcgatgcacgctctggaaggcacactgtactccggggccccagagggacttcgggaccagatagcttcatgggatgtgctataactccagaaagggacgcggctggcgatggaggagtgcatcatcagaacaccaacctgcgtcagacagagagcagacctgggagggcagagctaggaagtgaggaaaggcaggacctggcattccaaacagtgcacagaccatcccagaaccaactgtgatcacatcacaaactccctgccttctctacagtgctcaaatgccatctgcccttttatggagtccaagggccacctctaaccttcccgcaaagccccacatccaggttcttgggggtcccggctcaccagtccctgcagctctcccctgaagcccgtctagccccttccccatcgctgccactgccccgtagcaccagcaggccagcacacaacctccccacccctgtagcttcctggaaccacgcagggagactggcttggaaagacgccccagagatccgttgcgagacaaacagcaggcttcagctcctggcccgtgcaaccctgctcagcctcgccaggctgcttcctccatctgtaaagcatggaggtgaccatcctgccctgcctatccctcctgacttccacggaggtgatgaggcccaaaagagaaaattactccaacaatgctcagctgctgaagtttcacatatgccacccttaggaacaatcctgggaggtcctctgcagagataaatgctctgagagggacccacaagggcaaagagaggatgggaggcaggaaccatggccaggggttctgtgcagtttgacctgccactgcgtctcagcagcagggggcagtgaagactgctgatacctggaggcctgagcatcctctgtactggcagccaccaggctacagcaccaacgatgccagcatctgaacctcaagccacaaggagcccagaggccagccggctcctcacccatgagggcccagagttcaaacgggaacaagacatgtgtggctcatggaaaatgatgagattggaagtttcattagcaaaatgtgaaggaaggcccgaagctgttctatgtattgaaacccccaactagtccagccagctagcttctcagaggggctgacccgcctactcagtgtcccacatcaagttggcagcagcagaatgggcatcagaggtcaggctgtgggctctttgacccaaatccccatccctgaagccagcagagcccctgggtggggctctgcattctgactccctagaggaccaggtccaaactttccagttctgagccatttccttcaccgagacagcagtcagcagagcctctgggggctcactgcacaaagcccagggataccagagccccaccaccagtctggtgcagagccaaggatgtaccaacatattgtactttttttccctaccagtggccagttactagaacaaaatattttacacctgcaaacactcctgctgtggttttgaaatatgcctgcaacttctttgatatggctccctaaatggcagtagctccccaaacacataaccaccaaacccatttccaaacagcccccggggcaagtggaatctctgagtgaaggctccaccctcagtcactcctcccctggaccctggagctcctgactccccatcaccaccactggagacaggtggccagctctcctgcaacagtggagagggagtagggttgccaagcgctaggggagtgccagccactttctcccacagcccaaggggtcacaacactgacactggggaacaccacacaagaacaaagggacaaggcctatgcttcagcatttatttctcataaataacaagcattttctacctccaggagaagaagtgatcaccacctgctaccatctatctgtagatgctgtccaaccaaaacactggctcagctgctctgccctgtggcttctccttaggcagatgtttgggaaagaaggccctgtttaaaataagttatcctagaaaagaagggaaggtcctaagaaaaaggaagggatcatataagatgaaagaagagaaaggcaggtccaccaagcatacctattccatgagtgacactttcaagaaaagaacagcaacttgcaatcagtccttatttcatgggggttcgggcaggaggggctacatacttgggaataagaccagggcaggagggtgggacagaactggagcgagagctatctcgcatctgatgtaaacatcagccagcagtttcatccaacactcgcaccacatttcgatcatagccacaggatagcgcagccaatttctctaagagaaagaacagctgtagtcaaatcagattcctgaatgctcattttgcatgtgccaggcagtatatcaagtgcttagaatacattattatgaatccttaagacaactcatttgctccttccatgaacaccgccgtgtacctcctaggggccaggtgttgtacaggacacaagtgagaagagcaggaggagaaccataaggtgtctgcccccacgaagctcagattttactagggaaggagaagaacttcgtaaccttggggtaggcaaggatttattagacaaaaacagaaagcatgaccataacaagaaaaaatgataaatcagacttctttaaaattaaaaaagtctttgatcaaaagcttagtaaagatacacagaccacactgagcacagtagctctcacttgtaatcccaacactttggaaagctgagacaggaggatcacttgagcccaggagttggagaccagcttgggcaacacagggatccagtctctacaaaaattaaaataaaaatattagccacatatgatggtgaacacctgtggtcccagctactcggtgagggtgaggtggcaggatcacttgagccagggaggtcaaggctgcagtgagctgtgatcccaccactgtactccagcctgggcaacagagaatttatctaaaaaaaaaaaaaaaaaaaaaaaaaaaaaaaaaaagatgcacaggccaacagaacagaatagaatacagatctcagaaatagacctacacaaatgtagtcaatggattctgacaaaggtacaaagacaattcaatggagaaggtataacctttcaacaaatggtactagacagttggactccacatatcagaaaatgaacctcacactttgggaggcggaggtgggaggattgcttgagcccaggagctcaagaccagcctgagcaacaaagtgagatctcatctttacaaaaaaaaaaaaaaatcaaaaaattagctgggtgtggtggcatgcatttgtagtgccaactacatgggaggctgaggcaggaggatcacttgaacccaggaggtcaaggtttcagggagttacgattacaccactgcacctcagcctggatgacagagcgaaactgtctcaaaaggaaaagaaaaaaaaaacctccttaatcatcagggaaatgtaagccaaaaccacaataggctatcacctcacccattaggatagccactgtcaaaaacaaacaaacaaacaagtgttggcaatgatgtgaagaaatcagaactcatgtacatcgttggtaggaatgtaaaatggtacagtcactatggaagacagcatggagtttccttaaaaaattaaaaatagaattaccatatgatccagcaattccaattccacttctgggtacatacccaaaattaattgaaggcaaggtctcaaagatatattcatatacctatgctcacagaagtactactcacaataactaagaggtggaagcgacccaggtgtacactaaataaacaaaatgcagtatatgcatacagtggaatacaactcagccttaaaaagaagttctgacacatgctacaacatggatgaaccttgaggtaaaataagccaaacataaaaagacaaatactgcatgattctacttatatggagtatctaaagcagtcaaactcttagaaacaggaagtaggacggtggttgccaggctggagagagagataaaagggaggggtagttactcaataggtactgagtttcagttttgcaagatgaaaacattctagagatctgttgcataacaaggtacatactctggcactactgaacactgaatgaactgaacactgaattgagtggttatgatggcatattttacgttattaaaaaaaaactgcggtagcagtggagccgcctaaccctgaaaagcacatataaaatacggagggatttaaagtcctaaggataatattacaactgaatgaagtaactcctgcaagaaagcaagactagaaatctgacgcatctaaaaggagactgagcctacagcccagccatgggcaggcagttctgcccagttcctcccttgtctaacagagtgggtccaaactttagtgtgatcaccacagggagttacactcacaaaaagcacatgtcctatcatatggggtctttaaagaacattcaaaggaaacatttgcagtctgaaagcttcatttcctgctcttatttcaaaacctaagttgaacacaagatttaacacacgaaaaactctatccaaaaaacggggttacagttaaggttaatggagctattacatgccaagtgctgatgagggtgcctgatgctcagaaatggggatggggtggcagtgataagacagcatcagctaagaaccaaggcagggactgcaggaacaggctgcggggaagtgtcagcttcctgggggcatttgtgtggacacagcaggggtgggccctgaggagtcagggctgcggcacctggagcctgctgaagctatgggaagaagacaagaaaagcagggtgggtgggaaggttcacattgaaaaggcgggaggagagcattaggacaaatacctaatgcatgcggggcttaaaacctagatgacaggttgttaggtgcagcaaaccaccatggcacatgtatgcctatgtaacaaacctgcatgttctgcacatgcatcctggaacttaaagtaaaataaaattaaattaaaaaaaaaaagaaaaggcagaaggagaaagacaaggagtagatggaaaaagagccagagacttctcttgaagctgtgcaatatcacagcatgaactctatgctgcccatgtttcaaatacccactccatgactttaaaagctgtgtgactttggctaagtcacttagtctcccaagctctgtttctctatctgtaaaatgaggttaatatgagtaaacctacttcctataaaaagacatcacatctcatgctgcaattataaagcagaaatatgcaacagcattaagctaaaatttcatttaacttttttgtgggttctaagcattttagatctattttttctgttaagtagtatgttttatattcagttatacacatttttttccttttaaaataccttttcctcatcttttactttcatgaatgtttgttaagaagtaatacatccacacggttgaaaacccacaaagtccgtccatacaaaagaaggtgacactctaataagcctcccaagcttctggaaacacacaggtagatttgattgcaatcactgtgtggtgagatcacagagggtggtcaccagctggcctgaattgatcacccaagcccaaagagacatcacagcatcagtgtccacacaagatgctggtgcagtcagaactgtgaacactagcgatgcccaactcagtgaaaaggtgcccggttcttaggcaggaggccccaggtggtggcgctccacttagctccctctgccatacagctctttcatcagcttttggaatcatggtgcaggaggcaaagcatgtggctcaggatagcagtcctgagtttcctgttcttgcttctacttaaaagctaagtgatgccaccaagcaagctaattaacctctctgggtcttagcatcctaatctccaaaacagacctaccacctgcctcactgatcacccctccacaatgagtcttgtcaggtaaagggtgtgtagaactatacccaaactcccaggccaacctcagcccctgcttcagacagctcccccataccactgcatacccaaagactatcagagcacgaacccaagctatcggatggagaggaaacacaaagggtgatggctggtggaatgagaccctgttaaaccaacaagctcacaatgtcagcacttgggcccaaatagcccttgaacatctaaactcttttttgtttttattttttatttatttatttttttttgtctccaggaagaaactgaaacttaaaaagtgatttaccaagagttttgacaaaagtacatcaacgaaggctcaggactgtcagaaatgaaaaataattatttttaaaatatctatttattggctgagcatgatggctcatgcctataatcccagcactttcagagatgcaggcgggtggatcacctgaggtcaggagttcaagaccagcctggccatcatggcgaaaccccatctccactaaaaatacaaaaattatctgggcgtggtggcacgcacctgtagtcccagctactggggaggctgaggcaggagaatcgcttgaacccgggaggcagaggttacagtgagccgaggtcgcaccactgcactccagcctaggtgacacagcaagactccatcttttaaaaaaaaaaaaaaaaaacctaggaaaataataaaaccgttcaaaattgagatgcttccttaccaattagtgtaatgaaagaggggcttgttataaatactgaggttacagtaaataccactctcaatattatttaataaacatggtttcaaatcaaaacaggttttttttttggttttggtttttgaggcaggtcttgctctgttgcctaggctggagtgcagaggcatgatctcagctcaccataacctctgctcactgggctcaaacgatcctcccacctcagtcccctccaagtagctgggactacaggcgtgtgccatcatgcccagctaatttttgtagtttttgcagagatgccatattgcccaggctggtttagaacttctgggctcaagcaatccacccacctcagcctcccaaagtgctggaatttcaggtgtgaaccacccggccctgcctcaacacagttttgaacctaactgtgtaacaatcacatggaagagagaagagaattaatccaagtagcttttgaacccaagaaccttgagtatacaccatcaatctgaaaacacaaagagctaaaaaaaattaaattaaattaaattctacttaataggtctgctgttactagtggtgcgaatgcagtacttctgaaactattctgggtgcagtgtaagactaagcaaatgagtaaacctactgatgctgttgggagccagggttctcactgtagaaaaagagagaaacaaacatgcaacagagaaagcaagcaagaacctggaacgctggattagaactaaagaaacagtatgggccaggcacagtggctcacggctgtaataccagcactttgggaggtggaggtaggcagatcatgaggtcaagagatcgagaccatcctggccaacatggtgaaaccccatctttactaaaaatacaaaaattagccaggtgtggtggcgcatgcctgtagttccagctacttgggaggctgaggcagaagaatcgcttgaacccgggaggcggaggttgcagtgagccgagatcaccccactgcactccagcctggcaacagagcgagactccgtctcaaaaaaataaaaataaaaaaaaaaaaataacagtatgaacttacacaggcacagacacatgcacgtatgcacacacctcttgggctagactgaaaagatggagtcgcagcatactctagtagctagcaataaacacatctaccaccaaaatcctgctttctaaataccatctcccaccaaaaggaaccagcgctctgtgggaaaatgccccattccagtgtggggcaggtaaggtacaagatgtgcctggtaaaaaggaatttcaagttgatggaaacatgtcagaaggcgacacgctcccatcctgaaaaggccaggtgaaggggtttccacttgccaagtcaacctactgttatgtaggtttgaaatatttccaaagtaaaaagatttctaaaaaagaatgagttaggccaggcacagtggctcatgcctgtaatctcagcactttgggaggccaaggcagacggatcacctgaggttgggagtttgagaccagcccagccaacatggcaaaatcccatctctactaaaaatacaaaaattagccgggcatggtggcagacgcctgtcatcccagctacttgggaggttgaggcagcataatcacttgaacccaggaagtggaggttgcagtgagctgagattgcaccactgcactccagcctgggcaacaaaagcaagattccatttgaggaaaaaaaaaaaaaaaaaaaaaaagaacgagttaagacaatcttgccccgacccattcccacctttcctctccatcttttgttaccaaaggaaaaaaaaaaaaaagaatgaagttatatatgcactgatctacaaagatctcaaaataagttaaatacaaaaattaaataaaaaatataattccatttatgtaaaatattctatgtatgaatgttagcaaatgtgaagaaatatcaactttattttttctagattgtccagacaagatcttctacacccttgggctctctccatgccccatggcttaccatgctggtctagcaggcatccttcgcaaatagggtagatggggaaatccgaagagctgctcccactgtcaggagtggccaagaaacctccaagaactgcagcaaaggcctgccatggcccccaacaagcctctaactcttccaggtcctcttattctaagaccatagacagagttctgtaggtaaactaatctacctggaggccctaagaagcagccagtggcaccggagagacctctgcatcagcagacctagtttcaatggagcatctggcccggtcctgtggtcagtctcctgctgatcatccctgtgttgaccttctgggtccctctgctgtgactcctgcccctcatccagtgccctggccagccacaaacaatcctctccacaactatgaactcctaaggaaggtttcccagaaaatgagacttcccaggcaaggaagagggcagggtctacctgggggacccttagtccaccatacccaccagaatactgtcctcagtactgtcctgtccaacagtagcagccaacagctgaaggatgacagactaaccaaggaagacaagctaaccaaactgatagctgtctgccattttgccagaggtcagccagaagtcagcctacagggagggacctgtaggggacaagggcactaagaacaatgaccagctcagagtgactgaagcaacagctaccgcaggcagaggaggaggagaaggccaagaggcaagcatgtgcagcccatgcagcccatgcacccagccagctcttgaccagaaacaagccctgcactgtgcaaacaacccagggaaggtccagccacatcctcacacagggcagtccagttctcaaagccaggtgccagcaagtccatcagagaggcagctccctcagcaccggcttgctggggtccctccctctgggagcccctcaaccctccaccccaggctgggcagctggtgagcttcagtgaggatccacattaatgagaagccacacttgctctcacctctcagctcagctcccatcacagaagcaagctcctaccagggtggggcccaggccagctggctccacagccatgtcccctacccccggatcccatcctcccaaggcatttttgcaggactgccacaaggctctcatcctcctcgccacccccaccagaggcagctgcaaggcctgctggctaaagtagctgttgctctttatgtcaaaatataaataggcatttgtgcatttgttcaataactgatttctgagtgcccagtctgtgcctgaccaggcccaggtgacagagcatgaatgtgacaaagagcaaaacgtgtatgaacaatcccagccctgtccaaagcaccatggctgtttcgggggctctcagcaagtcatacgcagtccctctgatcccatcataacagcaaagagcactctctgtgtggcagacactcctcagagccactgtactctgccacctcctgagggagctctctcccgaccaataagccctgtgcacaaaccacctcacatttcacatttcagttcagggttcctgaactctatctgtgattaacactaacattttgcctgatgaagagtttgctttatgtcagacactttttagaattttatacttacccattttaatcctcacaacatctctataaagctctgttacgatgtccatgttccaaatgaggaaactgaagagtgagcagtagaacagattgagcctaggcagtgtggctctagagcccatgctcttaagccaccatacccaactgcctgccatgggccaggatgagaaggcttgatctaatcccagctgctacttttacagacagctcatttgaggcaaaaccagacctgagcttccccatctcccaggaggatgcccagaaggtccagggcatctgggtccacaggctattcaccctccaacctagacttgccctgccaagcccgccatgtccacactgacaggacacacagcttggaatggcaggatgagatggactggctttgactaaacttcccaggacaactggtaaatcatgtcagaaacacaaatacaggtgttacacagctatcacataataaccatacccaagcccatgcatcactctgctcaatgaactgttggcccaaaactggtctctcgggattaccgagcccactctgcagactggcagtgaaagaaaggaaagaggacggtcatcaaaacctcagcacccaaacataacagcacataagagaaaatctaatagcataccaaggaaaagacatctaatcagtcaagagctatctacggggtccttaaatgttgtcactgatgcattccacttagagtcaagaaactactaaatgccaatcgggtcgtccttatgccaacaaccaagagaggcagaggaactccctgcctgtcaaaggctcaggtccagcaggagagagtcaataactagatcacctgccatcagtgttgagaggatgcatgcactactagatcacctgtcatcactgctgagaggacatgcacacaaccggatcacctgccactactgctaagaggaaacatgcataatgagatcacctcccatcacctcccatcactgctaagaggacacctgcacaaccagatcacctcccaccatggctaagaggacacgtgcacagctagatcacctgcccttactgctaagaggacacacacagatcactcacctcccattactgctaagaggatctgtgcgtaacaagattacctgccgtcactgctagaaggacacctgcacaaacaaatcaccggccaccgctgctaagaggatataatcactcagtactctgggaagtgggaaggaaggggtggggaaagtgcccacaagctagcttgggaagtggagcagcgaaggcgcagcctaacacagcacaaatcttccacaacagcagtcttcattcctaaacccagaaccgccaactaaaacaataaccctgacatgcagtgatgccagcttgcctccacctgggccaacctgggctttaactacagggcttcctgcacccatgagaccttcccacgtgacacagggcttggcacatagcaggtgttagtgagaacgatggggtggggttaagtgggagcagcctctactctctgcaatggttaacatgtacaaggataaacggccatggcgcatacaacttattctcaaatggttcagaaaaaagcaatgtgtgtgagtacacagatatgcacatacacatggaagatgagggataaggcaaataaggtaaaatgccaacagtagggaagcctcagcaaaggatatgcaggtgttctctgcactcactttactcttgcaacttttccgggagtttgaaattatttccaaataaaagttttctttttgtcaagaaaaaaaaggaaaattcattagctagtgaaggtagaaagtatattacatcactttccaactaaaaaaaatgaacctgttaacccaaaagccaaatctaccagtggacaaactctacaaagtgtcacagtactggctacagaggaaagcactccaaactcaggaggatttggcaaggctaggtgcaagctcacctctccagctacttctgaacctcggtcacttttccttgtgatgaaaatatgcactctctccctatgcaccaaacccctgtgctacttcacatgaaagaaaactctggactccagccggggagaggtggctcacacctgcaatcccgtaactttgggaggccaaagcaggtggatcacttgagcccaggagtttgagaccagcctacatggccaacatggtgaaaccccgtctctactaaaaatacaaaattatcccagcatggtggcgtgcgccgtaatcaaagttactctggaggctgacacaggagaattacttgaacccaggaggtggaggttacagtgagctgagatcccgcaactgcactccagcctgggtgacagacagaaactccatcgcaaacaaaaaaaaaaaaaaaaaaaaaaaacaactctggactccagagccaaggtgctgtgttcacttctcagctccctgagatgtgatcagctcagcacagctgcctactgaaagcaaaagagaaagaaccctgagctagcagccagctccacctgggtctgaacccacgctctgctgctcaccagctgtgtgaccttagacaagtcacttgcctctcccagctagctgtaccaacaatagaaggaagacgaccttctagtcctctaccttaccaaggggcctagctgagcacaggccctgtacaggaccaacaaccagcaggaagggaccagggtgcaccagcattcagaaggcaattttttctcagctatgtatggtgggttcaacctggatagagctgtggctcatgatataattttgtttcacaattaaagctagaaagaaaaacagttttagaatcagcagtcgatgctgccttctctacacagatggagaaagggccaatgagacagtatcacaatcagtggtccccaaatccccccaccatctcgctgtcagttacctcagcagtagtctccaaccgttcttcctcatcacacccccagtgatcataacacacatcatcagtggtcacatggccaaacacagaagggatttggcagagggtgagtggttctgtccctcagactggagtatccacatggaaaaagattctgcaccctcacctagaggaccctgggacctaacaggggacagaggcagtctgtggctccacctggggttaaggaagctgttcagagcataatatgaggtactcctgtggctgggctggagacacacagttggagtgcacagaccccagtcacgggtgcatgatggggggaaggccagactcctacgatgaaatctcatctcagccttagcttcatgagtgctctggatttcagcttccccatctttaaatgaggctaaaaacagcatctagcagggacctcttgagagttaacatatgttagtgcttagaacagtgtccggcacatgacacatcttaaatcaagttcaaatgtgcacttaaaaaaaaattgctgggcatggtacctcaggcctgtaattccagcactttgggaggccaaggcaggtggctcaccagaggtcaggagttccagaccagcccggccaacatggcaaaaccccatctctactaaaaatacaaaaattagccgagcgtggaggcgtatgcctgtaatcccagctactcgggaggctgaggcaggagaatcgcttgaaccaaggaggtggaggttgcagtgggccaagatcacgctactgcactccagcctgagcaacagagcaggactctgtctcaaaaaaaaaaaaaaaaaaaaaattggtgaaaggtcaagtacagcaagcacttgctgccccataactccatgaaaggccttccaccctgccctgtaccagagaggaagcccaggtggcttggcatcatcttcagggaccccaccaggcaggagtcagaaaacaccctcctgagaagtgggctctgactgataccttcctcatactcaagtatgcttttaaggccggaatccccacagaaagaacgcagactaagaccagagaagccccagcctcttgcaagcaccagccaggcagatccctgcagcactctcaggaaggacacatggtgaatgtgtgaagaggcacacacgggcatacaaggaacacatcaggcccagaggcctgccctccctgcccagccaaagccaggaagccagctgcagctcccgggttctgcagggcaactcaagacgcctccaggggtagctgcaatgttctcatctggagagtcatggaatcgaaagaataagtttgctccctctaccagatccaccccacccatgccctactccgacctcagtgtgaggtctcctgtgacgccctcactgcttcacaggtacaaaaagatggccacctccacccacctctgggaccccacactccagggtattcaacacacaggagtgtgacaagtgacttacacctggcctctgttccacatcaggcactcctaaaaggaggggcttgttcttgtcacttggattccctagggatgggcagggggcaagcacccacaggcactttctcagttgctgctggccagttggcaggctatgtgaaaaggctggcaaggaaaaaggagtcggggacgtcagtcacctctatcacccaggcaggagatgctgggcctggaaccagaggcaccccaaagaagccaggcataatatggcctcacctgagcccggtgacctcatctgcaaaactgggactcaagaatcagaaaacggtgaccttctacctctctacacgtacatatatgttttctaaagaagttaatcacaagaatccacaaacccattggttctgacctccaagagcctatatgataccctcctccacaggtagcccttttcctggcttctgttcttaccaaggccaccccacaactagtcatcccgctgcccagagagcagccaaaagcagtgagcaactagctctacatggggagaccagagaagcatcactgaatctgtccaggttgagcaccggtcagggccttggccaccaggcaggcactagggaggaggcagacattccacatagatgacacaagcgcagagccaagaggtgcggtgtatctgggctgggagcctggctagggcacaggagagggccacacaccccgtgctcccacacccaggtcatcagagaagatggccctggcacttctgccttcatgggacctttcctccattaagaaatattaagagtcatgctttttcactgtattagtataaagatgactgtattaatatacatacgaaaacattttatttgacctaaaagttcattttttttctgctgactttaaaaaaaaataaaataacattcgaaggctactaaaagtaccgtgggcaagtgataccaggattcctgtgcctgatggatacatcggccctgcatttagggagtttgattttttggtgcagttcaaggggaggtacaccgaaataggtagaaaagggtctcctggttgccacggttctgattccccaccacagacttaagaacacactagctccgaggggagttccaaagcacggactcattcatcacatacacgcagcacggctaagggccccgcacagtggcgaggtctctgctcccgggacgctcgcgccggccacacaacgctaggctgactcctggtgcctcctctaggcccggtgggacctgaggacttccttagcgcaacgtctcactgaatgacagccacaaccaccgctgtccaggcgaggagtttccaggactgagaggctggcactaggccactgctgggaggacgtctgtgaaaccaggtgcccctgagagccactgtccccagcccgactccgacgctggactggcgagagggtgcgcccgtggcgtagctcctggccgccgccgctcccgggaagggcccagaggcaacatcctggacagcagagctgcacgaagtccgaggcgccgcgagcccaggtaagctccagcaggcgtccgcagagagtgccaggcggcccgcgagccaggccccgcccgcccctgccccaggcgcggcccctgcaggagggcgccgcgggtgaaaggaggtcccggggcgaccccggccccgctcgccgcccagcccccacaccgcccccatcgcgcggcgcacctggccgcagcggctcggtgacagtgagcacgagcaggaagagcagcaggaaggcgccgctgtctgccttgggcaccatttatcctccgttcatcgtccccggggcggctggaaggccggaccaggccggactgagggtcaggggaccgtgccaagcggagggtcaggcggagctgaacctgggcgaggcgcggagaggcggcgggaaagagcttcggctgggccgcgggctggcgcacactctcggctgcaacctcaggcaccgactccagctgcgcgcaagatggcggccgtcctgctcggctccgcgccgcgccgccccgcccc

SEQ ID NO: 1044 - DNA, 86173 bp, Homo sapiens; identical to SEQ ID NO: 1043

SEQ ID NO: 1045 - DNA, 86173 bp, Homo sapiens; identical to SEQ ID NO: 1043

SEQ ID NO: 1046 - DNA, 86173 bp, Homo sapiens; identical to SEQ ID NO: 1043

SEQ ID NO: 1047 - DNA, 86173 bp, Homo sapiens; identical to SEQ ID NO: 1043

SEQ ID NO: 1048 - DNA, 31646 bp, Homo sapiens
aggcccgccctccgctcgcccggcgcggcaggcgggtgccggcgaccggagagcctggacaggctttccagatggctgcggcggtcggtcggtgaggctttcccggctgtggtttggctgcgggcggcttgggcagcccgcgggcgcctcaggtaggtgcggggcgcgaggggcgcccgcgggcggttgggcgggcgccgcggcctgcgcgagggcgcgcccttccctcccgcctccctccgggaccgaggccgcgggcggggcgggggcgcggagcccggcctttgtgaggcaacatggccgcgggcggtggagagcgcggggtggggacgcctccggggctggggggcgggccccgggcccaggcgttgccgactctcgtcgctgtccgcccgggtaaagaggctcctctcccggagggcccgaagcctagcatcgccttcaggcgggaaaggtgtggacagggccagtgctcgcctgggaccctgccggctttaacacagtttgggaaatccaagaagtcgcctaagtctttttgtccacagaatgctcacgggttgagtgtcacgtagataattgggatacggttttattgtaacaatgagcatggcggaaataaatggaaggtggcaacctgttgacagtgatgcctgtctggtgtcaaccgatggacttgggtttcttgtggcaggagtctgatttgcctttttgcatgcttgcatgtaccttgttcctgcacggcagtcctgtctttggctgtcgactgttcgaggccaaccaccaggcgaggatccactgtttcctggccagactagactcccagctgtgggagtggcccaaaccctgctgcaggccttcactcacaaaagggagtgaatggccagcccggggtacccagtgttgcctctaagtgcgggatatgaggcctgttggaggatgacaaaaggaacggatgaggtcatactgccgctgggttgggcgggaggctgcagcgggagagacttgaccaaaaggcagcctccatggcgctggcactggtgctggcccgtcacagccagtgcctctgttagccaacacagcaagtgggctaggaggaagggtgctgtccaagtgtacgggttttctccccgtgccaagggtccaggggagcttgccgtgagcccgttcctgtccgatagtcctgttggcaaggcagggtttgcatgcggtgtttggtcagctggagcagtggggaggcctacgggcagagagctcccctttgagccctttgcggccaggcgctgtgtggagcacttcccaggggttgttttgtagtctcaccgtgaccttggggtaggaaatgtgcttctggctggcttgcccagtcttagactctcttgttgtagccctctcctttgtgatgtcacccagcctcctgactttaatgccagctttccttgacatcttcacagctccagccctggcctctcttctgatttccagcctggtgtttctggccacctcttccatatctccatgtgttactttggcgccaagtagccatatccaaaccaaactcaaatcttcacccatgccaaaacattccttggcctatctaaagtccctttgattcctctctttcttacaccttcatgcagtcctaaggaggccccgtcagctcacctatttctaagcacagaccatttctcaccaccttcaagttaacatcctggcccagcctacctggtgagcctctaattctctttactgtcaccttaggtcctcactccccatccaccatctatagtttttctggacacagagtgattcttctttctttctttttttttttttttgtttttttgagacagaatctcgctctgtcgcccagactggagtgcagtggcgtgatctcagctcactgcaacttctgcctcccgggttcaagcgattctcctgcctcagcctcccaagtagctgggactgcaggcgtccaccaccaccacgcccggctgatttttgtatttttagtagagacggggtttcaccatgttggccaggctggtctcgaactcctggcctcaaatgatctgcctgcctcagccttccagagcgctgggattacaggcgtgagccactgtgcctggccacagagtgattctttttatttttttgagacagagtctcgctttgttgctcaggctggagtgcagtggtgcgatctcccgctcactgtaagcttcgcctcctgggttcaagccattctcctgcctcagcctcccgagtagctgggactataggcgcccaccaccacactcggctaattttttgtatttttaatagagacggggtttcaatgtgttagccagggtggtgtcgatctcctgaccttgtggtccgcctgcctcagcctcccaaagtgctgggattacagtcgtgcaccaccgcgcccggcccagagtggttcttttaaaccataagatggtataaaacagaggcggtgtagatgcaagccagcttgcctgcttgtaaagcagctccatcacttcctggctgtatgaccttgagcatgtgggtgaacctttcttccataatgctatgtgagacctgggtgagttaaaatgcttaaagtgcttagaacagggcctggctgaggtttggttgccactgctatcctggaatcagctgatgccactgtgtgggccttcctatccggtggcccatctctctcactaagagccaaagtcctggcagcagcctgggaggaccagccctgatccatctgccctcatggacttggcccactgtcacgtcccctcagcacactgccccagctggccacaccacattcctgaccccagccctctgcttttcctctcagtgtcacctggaacatcccctcctcccagccctgtaacccacctggctcactcctgccttcacgtggatgcaggccatgaggccttcttggatcccccttcctaaaactgcctccccttcttcaggcgctttccttgttttgtttttgcttgaatacttcttggcatgtgacagggtgcatgcttttcttagttgttagcggtccatctcccccactaaaatgtgagctctgtagggcagggttttgtccaccttgtgtctgtagcatctaggatggtgtgtgtgtgtgtgatgaatggagaaagcttatagaggggaggaaggaacttgcccaggactgcccaccactgaggtctggggctgggcaggtttcctgctttcctaaggagctcactcacttgtaaggcaccaggctttcctgctgtgcatttcttcagtgccgccgcttggccccattagcacctttgcttggaacgtctactctagctgcttcttcgccttctgtggtagcaggcttccccattccgtcccactgttggtctctaatcccctgctccttgtggcttcttcatgtagctttttgtgtcccagaatcatggattgactcaccagggtctctatgggactgccaggttctgaggtgtgtggccctggtcttccttgtaatctgtggcactgggcgcattgacccctcggtctgttttctctaatggtctttcttggttgccaggagactgacctcaccccgcttagtgttcctcatgcctgcctggttgctgcccacagcctcttgagcgtcttcagcactttatagtcagttgttagctctgtgctgtgtttcctggatcctcagcacctttgatggacacatctttgggaacatacggtgtgaaattcccattagattcagaaatgttaggacatcttagaatccaggaaatggggtgacagtgcagtggtcattgacctgccagtgtgtccaggccctgtgaccttgtctcttgtccatatagtgcgttcctcggagtagatggccagtggatagttgttaaatgtattgattaaacctaaactagtctctggttttcatgttgtgtccccttcgaagtacatccaccatgccttgtcccttgttaaatgtgtgatgtctgcatctcctgttctttccgggaatcttgggaggatgttaggtcatgcagtgcggtttgcatgtgtgcatctttactggtatgcacgcatgtgcatgcatgcgtgttcctgtgcacgttgtgggagtgtgcatgtgcgtgtgtctgcatgtgttccttctgctctgatgcagggttttctggctgccccctcagacccatcttccctgcttcatgttgtccctttcttcatgcttcctctgtagtaaggcttcctagagttgcatccttaaccctcatctctgggtggccttcctcctgtgggtttggcgactacctcctcagtgcgtcctggccttccgtatctggaccagtcatggctccagagttgtggcctcggcaccttcagagcctgcctggaggtcccctctgttctcctcgccaggctcctgcctgcatgctggaatttgggtgtccttccttgtctttagttccctcttttctctgctatccacctccgttgggtcaacaagtgcggtcagttctgtgacactgttcttggcccattgccagggcctctttcacacctttgtcctctggcctggaggactgtccccgtgccttggatgcagttgcttctgcctggcacagctgtgggtctcccctctcaagtaggaacctacttgtggcatgagagtcgcttcaccttcagtggctccttattgtccccagggcggaacgggctgcaggtggcacccaggcctctctgtgcctcggctccagctgtctcttgtggctccccaccccaaatcctggcaggtcccttccccacagccacccacccctctcctccatcgggaacagaactatgctgccacctctggtgacctcagcacgctgcatcactgtccccgtccacgtgctaccctgtgggcccaggagagccctggggtccctgggtagcagagcgcctggccatgcctctgaggcccctagtgccgcagagttgagctgagggtctcgcgctcgccctctgactgacccagcccttgcaggtgagtggattgctgtgctctggtggcctgagggaggccacgcgccttctgtgtgttccagaaagggtgcctcccactgcatgcttgcttatctgagttagaagaatgctgtggtggagtttagtgtaaatttttaaaatattttttgagccttatgattatatagtttttgtgtttctgaagtaggaattaaagtgggcattaacaaaatatttaactttggacttaagttataattcaggttctgaagaataaaagtaaggttagtttgttttgatgcctaaaaagtcctcttagggaatattattttgaagccctttactatgctgttaatagtgcttggcttttaacttggtaccagggaattggaaggtttctgtcattttgtgacgatatttttaaatttctttgcaggtagaagaagaaaggtgccactccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggtatgttggcagcccctcctctagagggctcttagcaaaacccaaagagagatttgggaattgcagcatcttttgaaagcagggaaattaaaaaaaaaaaaaacaaaaaccaaaatcccctctgaggtggaataatgttaatgtggagaagagaaagatgtaaggagtccagatttttaaagtttcctaatgaaaagtttggcccatgggtaggccctgcatccctgatctagcgcgtggggcagcaggtgctgctgagttacgctccttggcagtgtgtgcccctggaccaggtgtgttggtgtcagctggtagcttcatcctgtttgtttttcagatgatcatgcaccctaagggcacatctaggccccctgagagcacctcctttctgtgtctgttctcaggaatgctgttgagctctcctgttgcaggagcatgagcgccaggggctctggtgtctgaacagcgtgttttgcaggatgactttgacaacgatgtggatgctctgctggaagaaggcctttgtgcccccaaaaagaggcgaacagaggaaaaatatggcggagacagcgaccatccgtccgatggagagacaagtgtgcagccgatgatgaccaagattaaaacagtgctcaaaagtacgtgtgtgggtcagaagcagtgggtgttccagggcagtggaggggtggttgcttccttagcagaaatgctttgagagagctctggtgccaggtagtgggctgggtggaggcatgtttgaggacaggacagaaatatctgaggagggaaacacaggatgggaggacgtcctgatgcatgacccagatgcggatcctggtgtgtgctatggaaaccacagagcagcaggcactgtgcagaggaatgggaggggacttctgagggggtcaggaggggatgttggtatatgccaggagccagcatgaccatcagctggagggtgtggagaccaagggcaaggtgggtacacagtgagatggcaggtgatagttgtgatccaggttctagtcctggaccaagtgtcacaggaagccaccagaagcaagtggtgttacctgatttttgtttaacaacatggcttctgggccacagcatggtgtgtgcacttcagctgggcagggtggaagtgccctggtcgacgtggcacttcctcaactttgagttgagggtagtggggagagcacttgagaggcgcccagagttgcactgtgaggctctgtcatcgatgtggtgcaggtgttgggggagtcggagttggtggcttggaggcacctatgagggtcctggtggagatgtggggctcggtagagggactgaagagatgcacggggactcaggctcacaggtgagaccccaggctgagggctggggtgcacaaggtggcagggtgcgactgggagcaaagcaaggggcgggtggcacatggccatcctccttgggccattgaggggacaagttagctatgccaggtgccacatgttgctgcctatgtcgtgttggtagcagttaagcaggagggcttttggtctagacggttgcaggcagggtaaacctggggcttcagcttctggggctgggggcaggagtcttgacctcggggcctctaggaggctggtttggtgctgcattttcaacaggctcattcagaaggtaaacccacattcgtcctgcacagctcactggtcagcagccattctggcctggatgcctggatgttcacagacggacagctgcatgtgacccccacctcaggtggctgggccaactttgtgaccactcactgtcacagaggagcagccccagcggacccgtggcccgtctcttgcttggctccgtattccctttgcttcttttcctgacttaacctaaagctggcaggaggcagctccatcttggcctgactctgtggggagagagcccacgcagtgtgcatgcacccctgacctttaacactccctccctgaatcatcacctgatggtggcctgggtacaggtgtcaggtccagggtcagggccacttggtgggtacctagccctgagagtcactggccctttttccccttatgtatattttttaaggtttcatttgctttcttctgttttttaattttttttttgaggcggggtcttgctgttacccaggttggagtagctcactacagcctcagcctcccaggctcaagtgatcctcccacctcagcttcccaagtagccaggactataggtgtatgccaccatgcctggataattttaaaaagttttttgtagagtcagggtcttgctgtgttgcctaggctggtctttctaagtttttaacttgttcccaatacctgtgagaaaattaagttttagttacatctttgccttacgctcttcccagcagtcaggcctggtggcaggtgtcaagttgataagtcgtaaacctcttcctcacaactgcctataaagcaaagaaggggttgggagtagtgtattaaaccaacttagaaacggaatcatttgaagcagtgttttgtatgctgctgagagtgcagctcagttacaataaagacttgtcacctggtcactgggagcagtggctgacagccatgcagtttattagcaaagctcatccagccccaaggcgcctctggccacaaccagacaggcagcaaaggagtccagtgtccacagtgcttaccagatgtggaggcaggagctgaggctgggacttatatcttgcacagacctgttctgtgctccttcatgtgctggtttgacacgtgtaaattcccacctcaggccacatgctatctgtcctaggcctggaggcatagcagtgagcaaggcagagaggaatttcgattatctgtgaagacccagttaaacacatgctagtacccaacaatttcttgtgcaggaggtgctgtggcaacaattccaagtgtttttacagtgattataggatgttcttgtcttcctgtgcaggtcgtggccgcccacctacagagccgctgcccgacgggtggatcatgacattccataactctggagtcccggtgtacctacacagagagtctcgggtggtcacctggtccaggccatacttcttgggaacgggaagcatacgggtaggggaggcatcagtcgtgactttaggcttgtaagttctcagaccaaaacgtgcacatccacacacatggcaccgcagccaagcagaggccggtgaaaggcatcagagtttcagactctcgggttgtccttgtaatccatattgcaatttcactatccacagaaacacgaccctcctctgagtagcatcccttgtctgcattataagaaaatgaaggacaacgaggaacgggagcaaagcagtgacctcacccctagtggggatgtgtcccccgtcaagcccctgagccgatctgcagagctggagtttcccctggatgagcctgactctatgggtgctgacccggggcccccggacgagaaagacccactaggggctgaggcagcccctggggccctggggcaggtgaaggccaaagtcgaggtgtgcaaagatgaatccgttggtgagtttttgaaggactcttcccttcttgcctcctgggacccatgagctttgtttttctaatgaaggccataattgttcatagttcctagttgtacttgtgagcaaggggctgtgcacctccactgttggtgtggctgaaaggcttgtcttcctgtccttgcaagaacctgcctgggtgcagcaccctaggctcctgtctgtgggctctgtggtgtctgcatggctgaggctgctggggagatggctgctggcactggcagtgggccgttttctctctggttgtttgtatgatctttccctaagtcttgctttttcagtaggatgtgctcatgtggcattgttttgatttgtcttgatgagctcagtgagcctctttaatccatgactcagtgttgggaaactgtcaccattctgtggatagttccctcttcaatcctgcaattgcttgctggatgtgtactggtgtttcccattctctcttccatgtcttttagcctagtcccgccatttaagtcttagttctctcttcaggtgtggcaggtctctgtgaacccacctgctggattactttcaaagagcactttccattttctaggtttctatttgtctgtacatcactacccagcctgtctcataactccgtggagtgtggggtgccctagaagagcctgtgatgggggctgttgctgaggatggggaagtggcccgggaggaaatgtgacaaatgcgaggccctgtgcagggagctgcctgggtgtgttgctgactacagaggtggccaggatggccagaaggaaaagagtgaggtggtcagagaggtggcgggcgcatggagcccgggtgctgctggcattcgggcacctgttttgatacagggaggaagtcccgaaggccatctgacttttttaagctgtcttttttccttttcatttttgtattcttcctgccccaaataaagtaaaagaacatctcagaaattcatccagaagggacctgccagaataatctgagctggtgtagggaggccttcattctttgcttccctcccctttgaaagggacggggaaaggaaatagtgtcatgtggcctgggcctgccccatgcactgggctgtgagaacctgactcctatgttggaagttaagtaatttgtttctctggtaaatctgggacagatctcgaggaatttcgaagctacctggagaagcgttttgactttgagcaagttactgtgaaaaaattcaggacttgggctgagcggcggcaattcaatcgggaaatgaagcggaagcaggcggagtccgagaggcccatcttgccagccaatcagaagctcattactttatcagtgcaagatgcacccacaaagaaaggtataagcctctgcattttaacatcagcagactggttatgctgttatttctaatgtgatgtgttgagggcatgttttatgagttgcatttcgttcaaagtttatgtttatcccatgaatgcaggggtctgccacattcacggtcgtgagcccctagttactgacatggtaacaggaagctgtgtgctagcttgtggcactgcttcacacttgctgagatggttctttttgtcacagagtttgttattaaccccaacgggaaatccgaggtctgcatcctgcacgagtacatgcagcgtgtcctcaaggtccgccctgtctataatttctttgaatgtggtaagtctaaccttccccatttcagtcctaaagaatcacaaggtgtaactttggtcagggctggggaggcaggcgctgaccgctagccctactctactggaacgggaggaaagggaagggtagagagcagcgtgctgcagatgggtggcttgtttcctggagccgcgccccatctgagtgggtggctctgcttttcccttccagtctgtcccctctccccaccttcctcttgtcctgccccatctgccttgctggtttctgatcctgcgttgtcatggacagccttattgcgagcaaggcctccccactgtgcactgggtcctttccctggtctcctggtgcccctgggtgtctgaagggttcttgggcatgcatttcccaccagctctgtcttccttgggtgccctcatcacacctttgtgaagaccagtctgtcttccccttggaagctggagcctgggggtcactcatcctttgaggtggtgtttctttggcaagccacatcttgtgctttcccattccggcagtcctgtgtccgtctttcgtagaccttggtccctgtcgtaggaggctctgcccccagcctcctgctgcccctctggctcaccatctcccacgtgcctcatttccctccactttcccagctgtgccctttgctgctgcttgtctgctgcccgtctccagtcccagggagccccaggtctctgcagtcaagcacaggcccactctctgcagggacagcccctgactgcgccttgtctgtcggtgtgggcagactgtgcacacgcttttgatgtcttgactcgtatgttttaaaacaagtaattttaattttaagagaacccaagtgagccttttggtgcctcggtgaccattgatggtgtgacttacggatctggaactgcaagcagcaaaaaacttgcgaagaataaagctggtaacgtgcttgcttgggtgtcaaagatacgtgctgcctgctgtgtctgcctcgctgcttggttagggaggggctgagcagtggtgacaagtgggggatgtgggtggggcatgtttattttatttatgtaatcatctactttgatttttaaaattacatgctcattggaaaagactcaaatagagcaaaatgtgagacttaaaagtagaaggcctcggccgggcgtggtgtctcatgcctgtaatcccagcactttgggaggctgaagtgggcagatcacgaggtcaggagatcgagaccatcctggctaacacggtgaaaccctctctctactaaaaatacaaaaaattagccgggtgtggtggcgggcacctgtagtctcagctactcgggaggctgaggcaggagaatggcgtgaacaagcgaggcagagcttgcagtgagctgagatcgtgccactgcactccagcctgggcgacagtgcaagactctgtctaaaaaaaaaaaagtagaaggcctctctactgagtgacagctgggccagtatgtccctccctagtcctggccctgcacatattcaggggtgtgcctagagccaactgggctgtgctgggcacatgctgtagtgcttgtttgtttttaaactgagcagcatgtgggcatgccaggagggaggagaagcgggccagcatgctgttggcatcctcccccagtggtgctggctcttaccggcactatttcctgagtcctcccactccatgtttgggcctagccacacagaacacctggcacagcgcagctctgggaaggctgtgtgtcctggcgaagacccactgcccttttggaccatgcccttgccgtttgcattcatgccctgcattcgtggtagttgacattctttcacaaaaagccatttgcctcagcgtccagggttagttggcttcttgtagggtggtgttgggtgtaccccaggccctcgcacccacaggttgattctcgaggtatctgtcattgccgtgtgttttccagaaggcctgctgcccatcttagattctgcctaagagacttttgcagctcaacaaagggggtgtggtggaggttttgacagataacttgcagtggggccttttgtgggggtggagatgccttgggcgtggctgtgtgctcttccctctgcgggatcacccgctttcctccctatgtgctggaacccacttcccttgcccagactcttggctgccctatagacagcttggctccatgtcttgccagcactgatagctctgtggggtctatggagccatcagcccttggctatggcaactccgaccccagtgggcatatccgtgccctgccctctagcagctccctctagcgtctctcagacctggctgcatctctccacccacgccagccactgctgctgccacctggtctaggtacctgcagtagcctgctctcaggcctccctgcatggtccagggcccgcaaagctgttttctcacgtgccaccgaagtggttccctaacatacagctccgagctcctccctgcctgctcccaggaccccagggtgagagcgcacacacccagtgtggcccgtgaggctttctggtagcctgccacacgtctgggcttttccttctgtcctctcctgaccctgtcactgaagtgctgtctctcctcagggccctcgctcagcctctgagctgtggggatgggaggcagcagtgcacagttcactctgcagggtggtgagaagagggcagtgcccaagcctcaccctcgggctcttttttttcatagcccgagctacactggaaatcctcatccctgactttgttaaacagacctctgaagagaagcccaaagacagtgaagaactcgaggtgagtgttgtggtcctgccctgctgggagctgtgtgtgcagtgcggctaccctgccctgttagtgtgagctgggggtgtccgtgggctgtgctcatgccttccatgccctgtaggttagtctcatccagcctccaggttcttctgtttgtatttcataaagaggaaacttgcctgtctttgtataggcagggaaaaaatgtcctttttgttagagatttttgtcctcttttgcagcattgagtgtgcaccgtaaatgtcgggtacacataggtttgtgatgggaatgaatctttgaggcagtctacaagatttagattgttcttttttttgagacaaagtcttgctctgtcacccaggcagtgacagagtttgatcttgacccactgcaactttcacctcccggattcaagtgattctcccacctcagcttcctgagtagctgggattacaggtgtgtgccaccatttctggctaatttttgtatttttagtagagatggggtttcaccatgttggccaggctggtctcgaactcctgacctcgggtgatccactcgcttccgcctcctaaagtgctgggattacaggcattagccactgcgcccggccctagattgttctttatatacttgacccttgagtaacgtggaagttaggggcaccagcctctcacgtggtcgaaaattcacgcatcactttcagtcctcccaaaccttaactacttactggtaacctactcttgaccagaagccgtaccagtaacaaacaattgattaatacatattttgttatgtacatattactacatctgtccccaacctagttttggcaccagagatcagtttcagggaagacaatttttccacagacggtgttggggggcggggatggtttcaggatgactcaagcacatcacatttattgtgcactttttatttctattatcactacactgtaatatgtaatgtaatcactatacaactcaccataatataaaaccagtgggagccctgagcttgttttcttgcaactagatggttccctctgatgacgatgggagacagtgacagatcatcaggcattagatttgcataaggagtacacaacctagatcccttgaatgcactgttcacaatagggttcacactcctatgagaatctaatgctactgctgatctgacaggagacagagctcaggtgtaaaatgagtgatggggagcagctgtaaatacagattaagcttcacttgctcacttactccccctgcccccaccactcatgtcctgctatgcagcccggttcctaacaggccatggattggtaccagtccatggcctgggggttggggacccctgatatatactgtattcttacattaaagtaagttacaaaaagaatgttattaagaaaatcataaggaagagaaaatttatttactgttcttgaaatggaaacatcatcatgaaggtcttcatcctccacatcttcatgtcgaatagctgaggaggagggggaagaagaagagttggccttggtatctcaggggtggcagaggcagaagaaaatttttgtataagtgggcccatggagttcaaatccatgttgttcaagggtcagccatgtgaagaaccatttaaaactagctgtaaacctttttgggtaaatggttatttgtagcaagggcttgtggaattttgaagggtgcattcttatttatataatagctttattgagatagtttacatactataaatttggccttttaaactatataagtggatttttatatattcagagttgtataaccatcataactacctaattttagagtatctcaacacccccaaaagaaactccatacccattagcattccctcttagttctctccaaccaccaaaagccactaatctgctttctgtctctatatatctgccaactctggacatttcatattagcggaatcatacaatatgtggtcttttgtgactggcttccttcacttagtgtgctatgtcagctgtaggtttttatcagaataaggaaatttccttttgttcctggtttgctgagagtttttgtaggaatgatgttagattttgtcaaatgtttttctgcttctattcagatgatcatgtttttttttgtcttttattttagtaatatagtgtattatattggtttttgaatggtgagccaaccttgcattcctgggatatatcccacttggtcatgacatataatgatttttttaatatgttgctggattcattttgctggtattttgttaaggatttttgcatttgtagttataagcaatattgatctgtagttttcttgtgatatctttgtccagtgtaacagcaggtacaggtatcaggataatactggcctcataaaatggttggaacatgttccattttcttctgttgtgtggaatagtttgtgaaggattggtgttcattttttaaatgttttgtagactgcgttcagtgaaaccttctggtcccaggcttttctttgtccagagctacttaattgctaattcaatcttacatgttataggtctattgagattatctatttcttcttgagccagtgttgatagtttgtgtcttttttggaatttttttcccatttgatgtagattatctaattgattagcatatatttgttcctagtatccccatatgacccttttttatttctatatggttgtgatggtcccttgctgtcattcctgatttcagtaatttgaggctttcttctttttcttgatcagtaaattgttacacttgatgatacatcacaggtctctgaggctctgttgtttcttctctgtacttttttctttctgttcctcagtgtggattatttcaattgccctgtcttcaagtttgctcctttatcttctgttggctcacattctgctggtaaacccctctagtgactgtttcataatttctgtcttttttaaaaaaattctttattgggtaatgcattgtttttatactttaattctttttttttttttttttaattatatatatagggtcaggcatggtggctcacacctgtaatcccagcactttgggaggccaaggcgggcagatcacaaggtcaagagatcgagaccatcctggccaacatggtgaaaccccgtctctactaaaaatacaaaaattagctgggtgtggtggtgggcacctgtaattgcagctacccgggaggctgaggcagaagaaccacttgaacccaggaggtggaggttgcagtgagctgatactgcgccactgtgctccagcctggtgacagagcgagactcctgtctcaaaaaaaaaaaaaggaaaaagaaaaaaaatatatatatatatggggtagagatggggtttcaccatattgctcaggctggtctcgaactcctaggctcaagcaatctgcccacctcagcctcccaaattgttgagatgacagacgtgccactgtgctggcattatacttcagttctttagacatggtttcttagtcctttgagtatgttttctgtaggtgatgtaaaatctgtttctggtaagtccagttctcagagagcgtgtatattaaactgcctttcccttcatgtatgggctgtctctactttcctatttctttgcatatctcagaattttttgttattgtcaagaattggacatttaaaatatatggcaactctggaaatcacattacctcacctcccttaagtttatagtttttgtcatatgtccttgctctctatttgtgactgtatcagtttgctagggatactgtaacaaagtgtcacagactgggaggcttaaatgacagagatgtatagtctcaaagttctggaagccagaagtccaaaatgaaggtgtcagaaggctaagagaaggcctttctccgtgggtggaggatagcgatctccatgtccatgcctttctctctgtgtgcatgctggtctccacattgcccatttgatagagacacctgtctcactggattaggccctaccctaatgacctcattgtaatgtgatgacctctgtaaagaccttgtctccaaatactgttgcattctgagggacttcaacatgtaaatttgggggtgacagtttacctcataatagtgactttcctagattgattctgtgaagtgtgtattctttatgatttgtggccactgaatacacgggccctttagctgagtggtctcctgatgcttggacagggattttcgtaaattccctgagccagtaagtctcccggcctgtgatgagagctgtgggtctgtggggctcacctggtgtgctccggtggctgccaactgtcttagcctttgtgtgccacctgcacagagtctccaggtcagtcagctgggaggttttcctgggcctgtgcgcagtcatctccagacatacgctagagcctttcagagccccatggacatctccagcttttccttcttgggttcttggccagcctcttgtttgcccaactagtgccccagcctctggcagctgcagggtgaaacagttgccactggttccttttgacaaaagccctcaggaactgggctgttttcactgagtgagatcaaataaagacaaatcctgccatgaggcttttccagagggtggccaggtaaacccaacagtgacagttctctgggcctggggccttgaggacccgttctccattgagtggctaccactgagctggggagaagggctgggaatggggcgagttaagatgccagcaactccttgttcttagcaagactcgttgtctttcttgaatcaacactcctcagattgttgaaagcctttctttagtttccagggttctgaaagaattaattctgaccatttttgctagtgttcttgttgctttaatggaggagagcagattttggaggtccttattcggccattccagaactactttaggatgggttttgtaaagttttctcatctttgtggactggtgctgttataaaatatggttaagtgtctatggtagtactaacttgctcttaagtttcttgaactcctggcttcaagcagtcctcctgcctcagcctcccaggatgatgggattacaggcgtgagccaccacacctagtctcttgctctcaagtttctacatgttttctgtgctttatgtaactgcttcatcgtggacaggctacagacagattgcagaccacatgtggatcaagcacagtctccaagtactagctgttccaggaagagtcacatttgtccctttttttttgagatggagtctcgctctgttgccaggctggagtgcagtggttcgatctctgcttactgcaacctccgcctcctgggttcaagcgattcttctgcctcagcctcctgagtagttgggactacaggtgcacgccaccacgcccggctaatttttgtatttttagtagagatggggtttcaccgtgttggccaggatggtctctatctcttgacctcgtgatccgtccgtcttggcctcccaaagtgctgggattataggcgtgagccactgcacctggccacatttgattttatttctgagtgacccaaccgtgggaaatatggctcccagggaggcttccaaggccctctggggaagtgcttgcgtagaccctggcccaccaaaactcttagtatgggttgctgcagacgatggtgcctgagttgtgtaggtctcacgctgccttcctgtctgagtaaaagccctgcctgttctttgctatggggtggtggaaatgtccatgaaccactgtggtttctggtgccaggagagggcccagcggggagtcaggttctcagcctccactctggggttcttctgtgaagtggagaggctttgcagaaaccacattgcaaagtagtctgagaaagaagaggtttccccaggtggagaaggacatgggggtggggcatgtggtggcttccgctgtagactcccctgcctggggctttttccacacccctactccgatcctcccacactgcagcctgtctggagctagcgtcatatctccccaggtaaggagctcagtttcgtgggactgcccccacttcctgtgccagccgcaaatgggggcccctgccacccggcacaggacccctcctcgtgcttggaaatttgctaggactcaggaactcaggaaaaattttacttatgaaacttatttttcatgaagggctgaaagttcctcccctctactgacacatttgatttctccggggagcccaccctggccacctcctcagcataagctctgtggtggggtcgttttgaatcacaaaagacaaacctagcactcaggaaatcctcagggttttaagaactctgttctgggaacctgagagaagaccgtgtgtttttatgatgccatgccttggtttagggtgccttttgtatgtgcccctcctgagaagctctttgaccctcttatttgtatatatgtcatctgtgggctgggcgcggtggctcacgcctgtaatcccagcactttgggaggccgaggcgggcagattacgaggtaaggacatcgagaccatcctggctaacacggtgaaaccccgtctctactaaaaacatacaaaaaattagccgggcatggtggtgggcgcctgcagtcccagctactcgggaggctgaggcaggagaatggcgtgaacccaggaggcggagcttgcagcgagctgagattgcgccactgcactccagcctgggcgacggagcgagaatatgtctcaaaaaaaaaaaaatgtatatatgtcatctgtgatgtccccatttaaaaatctgtcagaggggaaagtagcttttccctccgttgtagggtggtgggggtgtttagacaggggtggccatctcctgttcctgggaagtttctatttgctggtcctccctagcgaggctctcaggttgtgtccccgccccctgctcctcccagctgcctgtgcagaggtgccaacacctgtccttggactgtcccctggacagcctggggcgtggggtagtatcccctccttgtgtggactccggaggtggggttgacatgtcaggaggggcgggttgatgcctgtgaggtgtggtggccacgcgtgtatgctacttgattaaaaagggaaaaaaggaacaactggcatcatttccttttcacaaagcttgtggtgatctcttggtattttgttgctagctgtgggttggtggttcatggctattaaatttaggtattagtgaccaagtgttttcttttttttttttcatcttattttaaaatttacatagagttaaattcactttttggtacagtactgtgagttttgacaaatacacagtcatgtaaccaacactgcaatcaagatgcagaacatttctgtacattccaacattcttctttgttggtcaaactctcccacctgtatcctctggtgggcactgaactgcccctgtagttttgccagatcctgaatgtcctcttagtggagtcacctggtacgtagcctttgaacctggcctctggcttggtgtggtgtgacgcatccgtcgtgtggtcatttgtactcctgagtgctggccaccaggtggctgtgcccctcagtgcgtctctccattcttccttgagggacactgacaggtttctgggttttggtgatgggcagtaaggctgctgtaaggtcgtccaggtctgtgtgtgatgggcggattcgtttccttcaggtaaacccttgggatggggttgctgggctgtgtggcaggtgcacgcttatgttagcattgccctcacacctttctcagtcactaggtgaccgtggaagtgtgtctgttttggggctgtctactgtctttcgagctgtgtgtccttttcctgatgccacactttcctgatgacttgaagtcttgatactgggagtcctccaacttcgttattctttctcaaaaaattgttttggctattctagctcctttgctgttccatgtagactttagaaacaatatgtcagtttctataaaaaattctgggctgggtgcagtggctcacgcctgtaatcccagcactttgggaggccgaggtgggtggattacctgaggttaggagttcgagacctgcctggccaacatggtgaaaccccatctctacttaaatacaaaaattaggtgggcgtggtggcgggcacatgtaatcccagctactcaggaggctgaggcaggagaatcgcttgaacccaggaggcggaaggtgaggtggcagtgagccgagattgtgccattgcactccagcctgggcaacaagagcgaaaccccatcttaaaaaaaaaaaaaaaatctgcctgcattttgattggaattgatcctgtagatcaatctggggagaatggacatcctaacaatattggattttccaaatcataaacatagttcatctgttcatttatttaggtcttctttgatatctttcatgggtggtcggcagttttcatcacacaggccctgtgtatattctactagatttatagttaaatattttatgtatggcactgtgatgaatagtaccttagttccaattgattgtttattgctagcttacagagctagaatttgttttatttgcactgatttattctagtagtttttctgtagattccttatccagttttcttctctaatttgttaatgtagttaattacgttgtttttttaaaaatgtgttcctgggataagtcctacttgggcatggtatatgttccttttcatgtgttaatggctttaatttgctagttccctgctgcatctgtgttcttggtgttaaggtcatggtacgggtagtgtcatcaagcgaagtgggaagtagccctcctcctgagtttttcagaagggcaggacagatataggattggtatcatttcttccttaaaatttgggcctggagttttcctaatgggaaagttttaaactactactgtatgaactactaactataactatgactactctgaactactgttgagtttcttgaacaggtgtagggctgttgaggctactgagatagtttgtgtcttgccaggcattggtccatctcatatagatagtggaatgtagaggtgtcgggcgtctgtggtgctcccacacggtcctttggcatctgccaggcactgattgcttaggtttctcctgtgctgtttgtcagaagcaacagggatttgtctgcaggtcacttctgccatctgtctgctctcatgagctggagcctccacctgtccctggcgggttaaccctcagtagcacatgtggcctcaggcagcttggtgcagggcatcctggtgtcggtcttttttttttttttttttgagacggagtctcgctctgtcgcccaggccggactgcggactgcagtggcgcaatcttggctcactgcaagctctgcttcccgggttcacgccattctcctgcctcagcctcccgagtagctgggactacaggcgcctgccaccgcgcccggctaatttttttttgtatttttagtagagacggggtttcaccttgttagccaggatggtctcgatctcctgacctcgtgatccacccgcctcggcctcccaaagtgctgggattacaggcgtgagccaccgcgcccggctggcgtcggtcttttgccagaaacttctgagcgtgctctctagctgtgtgtgtgtcagccactgcctcagcttctccagggccagtcccgaagccgtggggtatgtgggttcttgtgggccgacagcactggacgttgctaattggttggctggttgacaaacccttgaggttccagggcctgatgtcttggtgagtgaccttccctggaaaaagacccatgttgatttgtgcacttgagaggagcagtgtcttctggggacctatttgaagacagtagccaagccatacctcgaggatttttcgcttgccaacctcagggctagtgccttcctcttctatgcagttgcagcgagttggccttgctgcttgctggagcggcgagggcagaggagctgcccactgccctgtctgtagggccagtgtccctgtggagcgggcttggcacactgtggagcctgcacagcgaggcgtgtgaatcatttgattctaggtttcctcgctgcccatgggccaggcaggctccaggtccctgcagacccctccagaacagggccagtgggggaagcactgtgagggtgtggctgatgggtaatctccagtgcttcaaagtgtggtcttttttggaaagaggatgattgcagatagaattaggttaacatgagatcacactgaagcagagcagtggtgtgatccagtgtgtctggtgtttctctaagaagagggaggaggggcagggctagtagtccatatgaaaatcggagcaatgctgccatagccaagggatgccggggccaccaggagctggcagaggctccctagaggcttctgaaagaggatggccctgctgaggccttgatttcagacttcagaatggtgagagaataaacctcttgttctaagccactgactttgtggtatgttgtcacaggagctccaccagggaggttgtccatgctccagagtgggctggatagcatcttcctttcacccaggaggcactctcagcttcagccaaagtcctagtctgggaaggcacagtgggcaatgtctctgcacctcagcctgctgcagcttccctatgcctcactgtgtggaatctccccatcacctcttgtttccctgtctgcctctcttgtccttcctgtgtgttcttgggttggctgcagagccagggtgatgacactgttggaagccttgctgggctgggcctctgctggccacctggggctgggctctgtgtagctgtgtggggctttggcctttggggagctgggccttttaaggccagcttttgggtctggctgactttccctctcctgtagtctcagttgtggcaatagtaaagcctctctgcaaaggtgctttatctttatagagttctgagaagggtgccttatggatcagaatcagatccaaataaggtgggcctggccagccagccatgtacctggggccctcttaggataccagactccatcccacagtgctcagggtggaagggtgctgtgggctctggagatgggcaactggacggtgaggtacggagcatgtcttgtacccggtgggttccttgcagagttgaggtatgaagtgctaggcgagctcacaagaacagacattaagcatctggggaaagccaaccgcaggcccagccatgaagaggccggtgggcctggtggggactcacaagcctctgctttgtgttgtagtattttaaccacatcagcatcgaggactcgcgggtctacgagctgaccagcaaggctgggctgttgtctccatatcagatcctccacgagtgccttaaaaggtagggtaggggggtgcctccccccatgagtcaggtcgggggagctcctctctggcgtctcatattcttgtggctgtttgtcccaaggcagaggcatggccaggtttccctgggtacacagcagccccttggccctggccaccagtcagtcccacaggcctgaatcgggcgtgtggagaattccctcctctggctgagatgcagtctggggagaggcttggtcatttcctaagggcttcccagagcaggcctcctcagaggcagctggctgctctgctcaggggacgccatctgttgtctgttttctcttaaagaaaccatgggatgggtgacacgtctatcaagtttgaagtggttcctgggaaaaaccagaagagtgaatacgtcatggcgtgtggcaagcacacagtgcgcgggtggtgtaaggactccttctctgctgcctggtggccgctgggcgggcggcccctggtgtggccctgcgcctctgtggcttggtctcagctgttgccctggcattgtccctgagcccagctgtgtgtgctggccaccacacgttcagcctaaggcggactggcagccgtcctgcctgcactttccctgtcttttccctttcccccgctgtcacccctgtctccgtccagcccttgtccctgtggcaggaggaaaggccctcctcctcgaacagccagcagaatcctgctgctccctgtttctggaggtgtgcgtcttggcgggagggaggctctcggctgcgtggctttgagtggtagtgtcctcagctcctagactctgagggccactctctcaaggtggcagctgggtactgtgagactcaggtgcccagagcagtggcagagtgctgcctattcctgtagaatgtgccctggctggccctcggggtgtgggtcaggagggctgggagcggcagggggccccatgagcactgggtgtttgtgaccccctctccatgcttgctctttctctgtgtaggtaagaacaagagagttggaaagcagttagcctcacagaagatccttcagctgctgcacccacatgtcaagaactgggggtctttactgcgcatgtatggccgtgagagcagcaagatggtcaagcaggtaactggccatcagcaggtcccagggcagcctgtgctgccaccctggagcgtattcctgaggctctgtgctcagagggggcagagctgggcagctctgctgttgctcacagctgcctctctcctgggccacttgtgtggctttgtgggcaggggtggggtcgtcccagctacatctcctatcccagcctgctgggcatggtcagtgaagtgtgggtgattgggaacgcaggctgggcccagctatgtggcttgtagggagatggccaaagtgcaaggcagggccaggcaggagatgctgaaggtgcgcccggctcggaggtgtgcaaaggctcaggagccagggccagctctccctgcttgaaggagagcgagtgtgtcagggtagctctccctggtaccagtgccggtccatctctaacagaagagcatatgtgtaccatctgtcttgtttctgctgttgtggccaacatcctgcagtgtaagccagtgcccactcctgaggggtggagggtaacatggggaggtgagtgtaatcattttcctcaaatgattacagaaactctctgggttcttgccctcctggtcattggaaggggaagtagttgtggaggggttaggcctgcaggtggggcagccctaggactgtgtggtgggtgggccctctgcccaagccagctgccaagagcagggcctgcctttaggtccctgagaccgaggcctcggcactgtccccgaagaggcctttactctggacatgataagggagggtgagggggctcacacgggccaccagggcatgttaaggaacttgagagagatttttgggaagcaagttgaaatgtaggtagcacttgcttctgcccttgctgtgcatggtccttggctgtgacggagggagagaaggcaagccccactctggcccgggggtgggaaacttccctgagcaggagggggaaaggtcccagccaggcacagccacagcttgggggagctctggcatcccgaggaaccacagcacccttggggctggcctaagacgggaaggggctgaggccagcctgatgctgctctgcattcatggagtgtgcagagagctcagtgcctgaggctgatgggctgggctgcagcgtgctgttcttactggctatggccacactctggtttcactccttgatgaggactctgggcaccacgagcacctcacctccctactctgcccatggcaggaggccatataagtggcgtggtgtgggcagaaaggcctggcagctatggactgcccctcgctctctgctgctgtcagtgggcctggcatcactgaggcgggccagtcagcatgcagttatgttgccacagctcctggctgtttcgtgtctgccagaccctgggcgcgcctgccttcagggtcccaggcacacagctgctgggcagcgggcaggccgtagagctacagcctgcagtcctgagcgtgaggtgctatacttcccaggagacatcggacaagagtgtgattgagctgcagcagtatgccaagaagaacaagcccaacctgcacatcctcagcaagctccaagaggagatgaagaggctagctgaggaaagggtgagtgccaccctagcgggagggctgccgggccacggccattcctgtggcacctgtggagggacagcagaccccaggacccgtgcctgagctgacaccttggaaatgcttggatcctccttccaaaatcagatacaggcttttctttgagcttcgacatgtgtgatagttttataaatcacttcagttttggttctgttgttagagagctggcaggccagcctgttggtggaccatgaaggtcacagtcttggtgggccacctgagtcccatgtcctccctgggtgtttggaggtaggtcagtgcacctgccagggttgaatctgtagggcttggtcctgatgaagcctcctaaagccaccttgggaaccccactcaaagaggggcctgtcaggctggcagtggtgtcttctgtcttcaggcatcgtctgcctggccacggcgtgacctgcccacctgggccttctgggtgggagctttcttaagtgtggcagtcccctggcctgggtgagagccccaggaggtatctgctgccgcccaggccagcaggtcccttgctgctccctggggtggggcttggcctcctggagccagtgggactgcctggtttgcccctggtcggaagaggggctgtggggctcaagggcagcaggtgcaggacatagtgctcctggctgggcctggggcaagcaaaagctgggcaagggaggaacacccaatggggaggcctggcctgtccctgtaactgcacccaaaattcttcacttcttggtacatgtcctgattgccagggaggctgcacatgttgtactctgatggcaatgcagggggcctctgcaatctcaggctggcctgccccaggccttccctgctcctcctagcctggcatcacaagcactggtgccgttggggctccagggcctcctggcatgatctgctgggctctccctccaccttgtgtcttcccgagcctctgccaagcccacctcactggtacccctgacctttgttgttctttcaggaggagactcgaaagaagcccaagatgtccattgtggcgtccgcccagcctggcggtgagcccctgtgcaccgtggacgtgtgagggaggtggcacgggccagggcgcgggggccgccagccgcacttctgaggagaccagcagtcatgcatcgtgcaccacagtgtcaggcctccaacccacgctccttccctgtggccaacctgtgggcccggccttagggtggaggctttagtgtacagggacagccatggccacacagcacacatgtggagcagcggctctccctggaaagctccaggcctgaatggatggactcagcgactgcaccagtggcagctggtgactgtggacagtggtggaccctgcttctgtgcacctgctgcaggctctttttatgaaggctttcatgaattttagtatgtaatacgcactgacgacacatgatgcttggatgacagatgagaggggatggctgagtcctgtggctggcccgtgatgccaggtggcccatgtgcccagggcgcctgcagggctgctacagggacctggtcaggaggtgcacatggtgccctgccctcacccaccctctgtgtttccccttctttgaaaaggtagaagagaaaggaatattttaaacctttttggcttaaacagaattttagcatcagaactagctttctgggattggaggcaaaccatcaaggtggtccctctccagtctggacacgatgccagcaaggatgacgtcctgccacctcctggagttaccctggcctcctagggtccctttttctgatgaagtcttaattccctaaaagcgcctctttggacactgaggccctctctgcctttcctggcctccggcaacagttttttacaaagattttttgcagtcgagtccatatgtccacccattgatttttaaagcttttgtgatattttagcattttgaaagactttcacagtgagagtagaaggtagatttggaatcatgcattttagcaagtggacttgttgaaacaggaagcaagggccttcagtgtagcccattcttgatccagagctgttgcctgtgacagcggtttctctggatgtcaaaggcagctgcctggtgcccagcttgcttctcgactggtggcccctatgggtgggtgtgcgatggaaatgtgttcctgccggagtctgaggcaccagggtgtgctcaaaggctggccctggtggtggactggcacctgtgcagagtgccgtgtgcttgtggtgcgccatctgaagcaagagtccagcgttctgccgtgtctgtcccccaccatgccccctacaggcggtactgatggcgcttttttttttttttctgtcaggaaaacaatgttggcctgtgggccgcccacaacatatccttccctcactacctgtgtgaccaaggttggcttctgttgacctttaaaaaagaaaccctcaactcaaattgctataattagacacttgcttctgtcttgcctcctgtctgcagctgtgaatagtcatttgactgtgactgttgcccttagccagccagatgcgcctgtgaaccaaagcttcgtgcacatgtgttcccctaaaggttggggagcctcgctgtgtcttgctgttcccaggcaccaccacagcaggtgctgccatactcttgtggtctctgtgcgccccccccccccccccacccgtctgccaagcatgggtatgaatcgtgcacacagccatgcttcaaggccggggcaggggagcctgtgctgatgccatccagggcactgggctgtgcctggaaggcgagccttgattgtctgaacacataaagcaaactgtccagaagggaa

SEQ ID NO: 1049 - DNA, 31646 bp, Homo sapiens; identical to SEQ ID NO: 1048

SEQ ID NO: 1050 - DNA, 66529 bp, Homo sapiens
caacttggcaatggaaatttattataaaataccctcagctggcaacacagcaggcccaagccaacgtctcctgcaggcctcggacggccagggctctggctggcccccagagtcaccgtcctgtgatgaggcactccacaaaaggaaataccaacctcatgaagacagcggggactccatggtccttgggccatgacttgctggtcctcagaggcccttgaggtttcaggccaaggctggggcctgatgcccacctccctgcccgccctcctcgtctcccgggaagggagtgggtgagtcatgcgcgtgggtagagtgaccagaggctgatccgctgatccttggagcccgcggccagcaagccatcggcggtgaaggccacgcactggacagcggcgctgtggaaggccagcacggccagtggctgcatcgtccgccagtggaacacgcggatgcggtggtcccagcctgcggtggccaggatcttgcgatctggccggatcgtgacctcggcgatcccgggattggtgagttcatgagtcccacgcacctgtgagagttgggagaggtgttaggccactccttaagcccacaaggcagtgctgcccctggtgccccacctgcagctggaaccaggagagacgcaggcccacaggcccgggatgtgagggccacacgctcctacccagctgacctcccactcttcctaaggccacgatgggggactccagccctcccctcagagtggtcttcggccctgccctgctgctcctcgcaccagctctgaccgactccttccccagtcagagagcagcagagacagggaggtcccagctgcaggagaggggctgggtcccgggacccctcaccccagggaagccactgcaccctagtgcctagcgagaggccacgtcccgggcttgatggcagcagaatgctggcactcctcccagaagaacctcacaaccaccccaaagctgacgagggtgagaaatacaaactccattttcagcaaaaccatgaggtatgtgaacccccaagctcgacagggctgggagcgctgccaagagcaagacccagtggggggttggcaggatgagggggggacaagggggagacgccctggaggcggcaggagccacacagtgtaccttgcctggtgggggcaacgtccccggctgggttctgagagggggtagggcactgcacgagacccggagccacacagacaggtcctacgtgcacggggccgtcggggtgctggcctcttcctgggccgagcgttggggccagggggtggtggcatgtgcctgtaatcccaactactcgggaggaggatcacctgagcccagtggatggaggctgcagtgagctgagatcactgccaccgcactcctgcctgggcgacagagtgagaccctgtctcaaaaaaaaaaaaaaaaaaagatacgctctaataaaattattagacttcatagctaaaaaacctttggtggccagacaaaaagaccatgttgatgagggtgctgtttaggccgtcctcagaatgctccacagccacagggtgccaagggatgacggggtgatgcctgcaaggctgaggaggaaggcgaggtccaagtattttatatccagccaaactgtcgctcaattataaaaacaacagaccaacatttctgaacatgtaagaactcagagaatcctgcacccataagctgttcttgaaagactagaagattaactccagtctcgtaagagataactggagaactgcagcaaatggtctggcagggagcactggacccacttgcctataggatcagctctaagacaatatggggattacggctatggaaccggttattataactcacagaaatatgggaggcactgagagagatgggatggttgttaagttcactgatttagctcagcttttgtcctttggggccaaagatataatagtcaacctcatccccgagagattatctgagaaccccccaccataagtaatgacaaaaatagcattatttccttctcctctcccacctcactgtaggtgcctatgtttccttgtatagctgcataaagtaaaaaaaagatctaaatatactcaacaggctgagtgtggtggctcatgcttgtaatcccagctgcttgggaggcaaagacaggaggattgcttgaggctgggagtttgaggctgtagtaagctaagatcacaccactgcactccagcctgggcaacagagtgagaccctgtctttaaaaaacattacagattagccaggtgtggtcgtgtagtcccagctacttgggaggttgaggttggaagatcatttgagtctaggtttatgattgaatttcaaagtgaaatctaaatctatgctaggtacaaggaggatgccaaaggaactcttggcaaagatatactgggaaaatgcaaataagaacagggtaatctgaataataggaacatttgaattcagggccaaagcattaggtaagattatataaaagacttaacaatgataaagagtacaattcccaatgaagagccatataatcccagcactttgggaggccaaggcaggaggactgcctgagcccaggagttcaagaccagcctgggcaacatatagagatactgtctttacaaaaaaaattttttaattagccatgcatgctggcatgcacctgtagtcccagcttactgggaggctgaggtggaaggattgcttaagcccaggagtttgaggctgcagtgagctgtgatcacaccattgtactccagcctgggtgacagagcaagaccttgtgctccccaccccccaaaataactgtaaatatctgtttagccagtaaactgacatatcatccataaagcaagaacaataggaaagtgtctataattgagaaactggtaccagactagtcttcttgctgtaaacaaccataaaaagtggacaaaatacacaaggcaactgtttacaggcagggagcactaggcagagaagggcagctgatgaggtgggcctcccaaatgcccccacagctctctgcctggagacaatgccatgagcatgaagtccaggcagaacatagtggtcacattaagctgaggaggcagagatcataatctgcagtagccagagggctgaaatccatggggcaaggcaaaggaacagagggagctgaagattgtctgagggggtccctatgagtcttgtgtgagggctggactgcgcatgctcacggtggactccacagggcttaccagagctgcacagttaaacagaacaagttcaagaggtcaacagtgccgggggtccagtcagcctgaatgtgaagactgtgtgacagcctgagaccagctgagctaccagaacggcttcacttcaggaataggattctatcttagagtatggcctaccctagatctaccagaacaaaactagaaaccaagccctgaaaaggtctgcaggagaggcagagtttggaagttgaggtccaccccactaaacaagcctgggaatgaactttccacagacctgccctaacaaagccaaaagccaagcctgcacaagctcaaggtgaacagtcagtaactgaactccataccagaatgaaagcaaacactcttcagagcaaaataacagaacccagagattcagcatgtatcatttaccatgtctggcacacaaacagcaaattagtagacatgctaagaagcaggaatatatgacccatagtcaaggggaaaaagcagttaatagaaactgaccccaaaatggcagagatgttgaacatatcagataaagactttaaagaaactccttaactatgttcaaaaaatgaaaggagctctctcccaccacccaagatgccaaaaggaaagaaggccaagggaaagaaggtggctctggcccctgctgtcatgaagaagcaggaggctaagaaagtggtgaatcccctgtttgagaaaaggcctaagaattttggcatcggacaggacatccagcccaaaagagacctcacccactttgtgaaatggccccgctatatcaggttgcagcggcagagagccatcctctataagcggctgaaagtgcctcctgcaattaaccagttcacctaggccctggactgccaaacagctactcagctgcttaagctggcccacaagtacagaccagagacaaagcaagagaagaagcagagactgttggcctgggctgagaagaaagctgctggcaaacgggacgtccccaccaagagaccacctgtccttcgagcaggagttaacatcgtcaccaccttggtggagaacaagaaagctcagctggtggtgattgcagacgacgtggatcccatcgagctggttgtcttcttgcctgccttgtgtcgtaaaatgggggtcccttactgcattatcaaggggaaggcaagactgggacgtctagtccacaggaagacctgcaccactgtcaccttcacataggtgaactcggaagacaaaggcactttggctaagctgatggaagctatcaggaccaattacaatgacagatacgatgagatccgccgtcactggggcggcaacatcctgggtcctaagtctgtggctcgtatcgccaagctcgaaaaggcaaaggctaaagaacttgccactaaactgggttaaatgtacactgttgagttttctgtacattaaaataattaaaataatacaaattttccttcaaaaaaaaaatgaaaggaaagtgtattcaaataattacccaaaaaattgtcttgagtgagcaaataggaactcttagcagagaaatggaaattataaaaaagagtcataatagaaaatatagaactggaaagctcaatactgaaatgaaaaatgtattgaataggcttaacagtagattggaaatatatattttttaaagtcagtgaactggaagacagatcaacagacattgcccaatctgaagagagaaaaaacgactgaaccaaaacaaacagagcctcagggggccatgggatgctatcaaactgtgtaactcatagaagccccagaaggaggagaaagtgaaaatggtcaagaagaaacagtggctggatatttcccaattttaatgggaaacacgaatatatagatgaaaagctcagcagaacccaatcaggacaagaagaaaaatctatctaggcacatgatagtcaaactactgaaaaccacagataaaaaaaaatcttgaaagcagccacggagcaagacatattacatgcatgggaatgataggatatcatgagttctcatcagaaacaatgtaacaacatctttacagggcatgaagaaaaataaaactatcattcctaaattccatagccaggattctgtaaaaatgagggtgataaagacattttttagataaacaaaagctagagaattttttgccagcagaattgcactacaaaaaaatgttaagaggatacttgggtctataggatgagcaccagaaatggcaaaggggtgagtaaatgtaacatgttatgttttttatttcttgtaagtttttttttaaactgatgatttaaaggaaaactggccagatgcagtggctcatgcctttaatcccagcatgtgggattgcttgaacctaggagttcaaggccagcctgggcaacatagtgagaccctatctctacaaaaacttatccaggcatggtgataggtgcctgtagtcccaactacttgggaggctgaggcaggggtttgagggtgcagtgagctgtgattgcaccactgcaccccagcctgggtgacagagcaagaccttgcctcaaagaaaagggaaactaatattgtaaggtgcagttttgaatgtgtgtagacgtcaagtagatcacaacagtcacagaaagactaaaaaggtgagtagaagggattgcaccagcacaaggtcatcatgtttgtgaggcgggatgtaaacaacactgattctaaggagactttgagaaggttgcacactcttggagtgcaaccacttaggaacaaaagtggcaagaggtctagctaagaagccaagagaggaaacaaaaccgaatactaaaaaataaatatttgattaccacaaaagaaggtaggaaaggaggaaaagtggtcaaaaatggaagtgacaagtagaaaataagtatagaggtgttagacttaatcccaggcatgtcaataattacagtgaatgcaaacagactaaatgcaccagttaaaaggcagagattgtcagaaagcatcacaaagcaagacacatctgtctgctaaagatgcttttcattgggaggccgaggcagacggatcacgaggtcaagagatcgagaccatcctggacaacatggtgaaaccctgtctctactaaaaatacaaaaattagccgggtgtggtggcgtgtgcctgtaatcccagctactcgagaggctgaggcaggagaatcacttgaacctgggaggcggaggttgcagtgagccgagatcacgccattgcactccagcctggtgacagagtgagactccgtctcaaaacaataaaataaaataataaaataaaataaaataaaagatgctttttaaatatcaagaggtcaggacaggttgaaagtagaagcaaggaggaaaatgcaaagggcaaacctaagaaagtcgatgctactgtttagtatcagacaaagccaacttcaagacaaagagcattaacaagagacaagggacactttgtgctgagaaaaaggctctgcaccaagatgaggtgacatctcagcgcctatacacccacactgagccccagagcttcaaagctcatgaagcaaaactggcagagacaaagaaacaggcacgtttgcaatcacagttaaagattttaagagccttctctgcgtaactggtaaaaaaaaaacaaaactagaccaaaagatcggtaaggatattaaagactggaaccacgtccactgacctgggtcaggctgacggaaggctccaccccacaactgcggaacacacgctcctttcaagtccatgtggtgcactccccgagacacgccatgtgctgggccaaaagcaagcctccataaatttctaaacactgcaattgcactgcgtgcattcactgacaacagaattaagctagattaaagatatagctacaaaatcaacgaatatttggaaattaaataacacacccccaccaaggaacctacagatcaaagagaaaatcacaatattctgaactgaattaaaatgaagacacagtaagtcaaagccaatgagactgagtcacatggaaggtggccaggctgggagctgaattctcagcagcccagggaggtggcaggacctagacccatggcccagcagctgctgctgctcagagaacggcccctcagcatccaggcccgtgcatcagaggccaccagcacagccaccaagaggcccctgcctgaggaatccctaaaggatgcgctttttggcttccagaaggaggtcttgagatgtaagaacacccagggcaacgctcacacacgacatgcaatcatcgatgtgagaactggctccataagagatgtgtctacgcctggagggccaggaaggttggaggtaaaatgattaaaatgtaaaggctataaagggaagtagtgaccaaaagaaacctggactgagccatattaatagttggaaaaataggctttggggcaaatgtcctttctagagatgatgagggggaatgaagaaaagacctcattcaccaggaaatcaccattttaaactggcatgttcccaggccagcttcaaagtgcataaagcaaatacagacaggcccccagcaaaagggaacaggacaggcctctctgcgcctgctggggaccatggtgacctgcaggatgacttaaagggctaagaatcagtggacacacgggcctggcgcccacgtgtgcagcggggcatctgacaaccagcactgcctccctggcacatgtgcaatgcttatgaaaactggacggccccgcatttcaaagaactaatatcattcagaccttgttcccagaccacaatgttaattaagttagaaattgaaaactaaaaaataactggggaaaaaaatcaaacattcagaaccataaaaacattctaattaactcagcagccagagaacaaataaaaatggggtctttgtgtcaaatgaggaatatggggaaaaaataataaaaatggggtctgcctggaagtggggggaggaagacaatgtcttcttgcaccagggagcccagctggacagtcacctctggaaacaggctccatgtggggctggcaagggaaggctgagtgccgatgggctgtgcacctgaccccaggcagggcagcagatgcaacccaggggacatgggatggagggagagcatggcaaggacagaaacaatgaacagaaagatagaaatgctcaaggacaaacgcatacaagactgatcaggaataaagcagggacggagctttgaatgcggcagaaatttaaacaatcatcacaagcagtccaaaaaaggtcactaggaatacaaccttcaggatttgtatgcccacagacaaattcctagaaaaattccccaaatcaggaaacctaaattagtccacaaagaaaacaacctgggcagagaaaataactgcccagtaatggtgcaggcgaagaccaacctacagtcactcacgaccccccacctccaccgcccaaatgtgtccatccatcgggagaagagggaacgctccccaccagctccctgagcctggggctcctgtcactaggcaggtggtgggagagggaggcccaggtccgtctgtggccctgggcagttctggcccagcccagcagagtgggcggagcacatgtcacacacgggagggggggtgggggtgcaggcggtgatttcaagacttttccctgagattcagggacagactgaggattttagttgttttaatgtttaagaaaactccaacaatgcaatgaacagattcaagaagaaaacctgtatgagttggagagatgcagtgagatcatttagtgacatcaggcacccattcaagacccagattctttccccaggaggggtgggaggagcctcgcctggcgaggagatgccaccaaacaacccacagctagcgcagccctcaccctggcctgggataccaccgcctgcgcccccaacactgctctaggctcctggccagtgaggtaggcgccttgccatgccctcagccacctcgccgtcctacctcaacaccagcttgtctctcaaggccaagcccctgcaagcccatcatcctgccctttcaaggcctctccagggcccggggccccctggttcacggacttaccaaggcctgcagccctgacccctctcatggcccctcccctcccaccgcgcactgtaaccagcacagtcccagcacatcccagacgctctgcctgtcctctacctctcttgcctggcagaccttggctctgggggtctcggcggtatcctgcctgtgcacacacaagcagctgaatgtgctgcagcacgacacacagccattggttggcaaccgcaagcccaggctggcctcagtgtccagagcacccggccttggcgctgcctcccctccctccacaccagcccctacctccccacttggctccctgtgacccggctgaggggctgtcaaggccagcacctgctgcgcggggccgtcaagtccagcacctgctgcgcagggccgtgaggggatgctggcatgtacctgtcatgcgtgtggggttcgccgcctgtgcttgcagacccaggagcccctccccagctctcagggaccagaacacagtggcccagggaaggaactggcggctgggaagaacaggaggctgatttgatgccatcgtcacccatttctctcctgtgacctctgccctaagtcagtggtagagagggaacaacaggccacacgccatgggcctcactggaagccactggggcctgctcagggccctcttgacaggaatttgctggcaggtccttcccagggagaaaagagctgccaaatgcctggagccacaggcgtgtggggaggtttccgtagaagtcctgaccagggatcttcacctgtggaggctgagatgcccagttcctcctgcccagctcctgcccagcagcctggctgtgcctacccaccagccaggcggccactgcctgcagggacaggagcgaccccacacccacctcagccattctcagaaagcagtgacagcatcaaggtaaagaaaaccaggttcaaggaccagcttcccgcaggaaatgaggatgatgcgggaagcctggtggggcctcctggagaaagactagggcctgctccagccctgtgttcctgaagaagaggaggactggtcctggccctgcagtgacagcagccagggccctgcactaccgtgctcctgatggcagatggaaacatgtccacgccctgcacaagcctctcctcctgatgcgatgcacggggagctgacccggggccctttggcctccctcctggctgcccagcagctctgctactgccctctaaagggaagcctctggcagacagcgcagcagccaccactgctgtgcagatgggagcgcagctgggacacctggccatgtcttgtgggagagccacggttggtccacttcccagaccagggctgcctggggtgggggagcctcattattacttaaagccctaagaatatggctggctgtaaatcagtccccacttcaaggctgtgggcactaccccaaaatgtgggagggagagggcctgcgtaccacctgtatctgatgacaacacaggctctaactgtgacagctcacgggaaagccgcctcagcaaggcaggctcagggctccagtcaccacttgaccccgaggcaccctcaggtggtatcctgatgtgggcagcctcctcgtcaccaccgcggcccctggccaagccccagcctggacctgggccttccaggaaggatctctggccaccagtggctctcgtagcgcatgacctcaggtgccaggaatgcgtggtgcggcgaagccaccatctggttccgattacccatgctctgctccaggaacctcattcgcgtctctactcccagcacccgccggggggagactgatctgggctcatcagaggcttcggcaggagggtgtgagggggacacagccgtgcccacgtggctctcagccaaggagtcacagtgcaggcggtgggtgaggacacctgtgggtgctgaggaccttcggtcaccttgcttgctcccgggtggcaagaacgctctcaggcagctcacctccgaaagcgcccccacaggctttccctgaggctggggctttacagaacctgcaatctccagggcctctaggatcaacgttaagatgtgacattgggcagagggtggcgcatcagcctctccggctccctgtcccctgttcctggagtcgcctgtcccctcccaggcctcctcctggcccatgcaacacagggctcagcaggggaaacgcctctccttcgatgtgcaccatgggccgatgccctgcccagcacgccacagccacgccaaccactccctgttcctggttctcccttctgctctcactttccaattcattaatacctggtcccccttttgctttaacttttcaattcatcaatccggtcaagttcatctctggactggaacatgccccataaattacagtcctaagttccagcagctgtttcccaaacacaccaggagagacgaggcagatctgggccaggacggcaggagggccccttcctggggtcctgggcacagaggtggaaactgcagagaagagccctccgggggctctcagggaagctgtctgggtcttcagcgctttgctgtcaggctggtgaaggacaagccagtgccaagtgaacactggaccccatgggggcagccctgcaggatccctgccaggcttgaggaggagggagggagtgcaagggagacgccccttccagacatgcagacccagcacccagagtggctctgcctcccagcgcccagagcagctcagcttctagctgctcagaacgggcatcatgatgatgacacatccaccgaccacccaggcctgctaagccttaggagacccttcctcccggggagacatgagaagctctgccgcttacatcagggccttgtgcccccatccccaggacagctgacggatgggtgagggatggacacagctctcctgcaagtctaccatgtgcctgcacaggttggtgatgcccacagggcactggggccgctcacagaaccctgcccctctgtgtatcctagtctcaccagggcatgtccttccgcagctccaccatgtgcttcaaagactctggtggtgcccactcaggggtgggcctgacggacccgaggtgaaccctccccgccccacaggggccagggctgggcaagcgtgaggcgcagcaggcttgctggggctgcgggcaagtctgccctgcctggggggcccgaggaatgccctctctgtggcctcctgtcgtacagacagcctggaccacagccctacagagaagggcagccccgggccctgtccttggtgaggctgggagctgttgctgcttctgccagtagtcacctcacgggacatgcagctccccctggaggcccttcacccactagactgggcaatctgaccactcgctggctatgggtctcaggcttccaagacttctggtgaatgggggctccttgtccaccccccagaagccaggatgtacccaggccacacccagcacctcatctcccatggtctctgcagcccctgagacttgcaccagagtgagacctggacaggagactccccttgcccccaccagcctgacctgatccctcccatcccaaacagggccacgtgtaggccaggccaccctggagccacaggcccagacagggacaccacggtgcccctcgagccatgccagctaggagagcccaggagacaccatgggaagatcttcagcaaccgccaggtggccctgaggcttcccagccttcctgctgggctttcctgctgcccgtgagcaatggcctccctcgggccagctccagaccaccacgggggctgcagctcctcgcagttttccacactggttttttttttttttttttgattaatcagttccttactgaccaaattcctctgagttttcacaaaggggtttgagtattcctggactctgcgtgcctttctctagatggacaagatgtgacggcatgaacccgaggtctgggcgaaacccaaaccatgtgaatggtctgccagcgcccacgcccccttcttcctgcgccagccatggacagcccccctgcacccgcctccaagtgattaattagccagggatctgcaacaactcctcttcatgcctaaatattgtttcagcctatcagactgttagtgcagagcaggataaatgagacccggggcctggcgcactgacctgcagggcctgctgccagtccaggctccagacagccagcgccttccccgcggagcctgagatgcccctggccttctgggagtcaaagtcaaggtccatgacgggctcctcatggcaggcgatgcggctgcacaccttctgctcagagacgtcccacaggaccaccgatccatcctcatagccggccagaaggagtgggcgggagctgcagtcggcctgcggggaacagcagagcagtcagctcctggaaggaccctgactccagtgagtttcgggggagaaggggctctggaaattcctgcccctcctgctggctggggctgtttcccatgtcttccacgtggctgccacagctcagaagctctgcaccgccagtgccctcccacacagcccctggatggctgatgctgtcagcatgggactggcacggctgcccttagggcaccccaaggacataggggtggagggcagagagccaagcccaaggcctcccactgctgtaccacttctcaccagccctgcaacctgcatgtgcccaccctgggttctgcccaaaggggtgatgctgggcacccaccagccactgtgagtgctgccgaccctctccacttctcccatgcacagggacctgtcctcctgcctcctttccccaggcctaagatgtgtggccaccacttactggggctggtcacctgtctagagccgccagccagaagaaaccgtgagctccatctccatgaaaaatgaactctctgtgctttgtcaaagtggctgccgaagcccctgcccctgaagcctggcgtgagccgcccgagctcttgtgatgaatgagggcgcgggtcagagggctccaagccctgggcagacacctcgtttgttaagcctctggaataattgcaggaggagagcactgcaggattccgcatcaccctggggacacagccgtcagtccccggcaccaagaatgacagcccagagaaacctggcatggctgagcaaggagacctgagggagccagaaggcaccagggcgtgtgcctaacaaagggatgctgagtcctcagacaccacaaggaccagggctcgctgcatcagaaggctggtgatgggaaccggggtagccaggcccggagcccgaggccaactgccctgacctggaggggatggccatgccagggacagaaggacactcactgtgccctgcaggatgtgggcatgtgaacccgaggccagagctggtccagtggtcctcatacatgtccctgaaaaagacttgtaaaaccactgggttctaataacagagttcacacagacaaaactgagaagagtgaggctccaggaggaggcgagtggcggtcagtgtgtcttctcccggggcacctcctcccaggcctcatcccaagtcatgccccgctgccagagtccacattgtccctgggaggcagggctgccccagggccccgagtgtactcagccccctgcccctccctgcagaagtcctggccacgctcctgcgtgtgctgttttatccctgggaggagttccatgttggcacctttcagatcacctgctgggaaatgaggcgtgcagggacccacagtactttccttcccaacatgggcaccatgccttctgcacagaagctccttgcaggcagccctggctccctagaagggcctccccctggtaagtggtgcgtctgaactcacagtgggtgagggccaggcgagagcagcggggaacactctgcatcccaaccaggaatgcaggccaaccccagaagctgactccaaagactctcctcattggacccactcccctcaggcagcgctctgtggtggcacctgttcccagcctgtgccaccctcctccccggcactttcctccactgcaggagctgagactgcctggggctgctcccatcaccgatgtccttctggcagtctcagagcctagagcctgtgtgaagccactgcctctgaattcagatgccatggccaacgcagggactgtgtgtgtgactgacccgcctgtcgtggtgccacagggtggctggagcagaagccaacctggcctggaggggcttgccctgtggttgccagcccctgctatgcccctggtccctgcagccccctagtgacagataccacaggccgggcagtcctcttgtggctggagcacttcggtgcccacagccttgatgctgcctgacctctgcaggggagaggatctgaagtctcctggacctgttcttctctgccccctccctgcccgcagatgagacctggaggccaggcctcattctgcacccctcccattgactggcacccccagagggacacagcaggtcaggggctgtgggaagccctccatgcaccataccccaagaagcagggcagggctggctggagtggcccctgccctgagggctatgccagtgactgcctcaggcttgacgtaggtcctgaccttttatatattaatagcaattattcttatgttgcaggtcagctgcttagaggagcaaaataagaatatactaaaaattaaaaattaaaaaattttttaaataaataaaaatgtgattgccccccaaaaaaagaaaaccctcaatgtttcagaaaaaaaaaaagcaagtcaggccactgtgccacaattggattgataaattataacctgaccctcaggcttggggatggaaaagggaacatgtggagttaatgtcggcttttcttagcggaatgcttcacgctggatctccatcaccaacagaaacacgatttgtcctctgtcaactacattaattaccttaacaagtttgtacatccctttctacgcatttttctgttggaattttacatgattgtgcaatgacccacgtttcccaaggggtggaacaggagccgtgcagactcggacacccttccccaggacctggatgccctgcccactgcctgcggggttgcagccttggggggcgtttttcctcccagcggagcccatgtcaagcccttggaggagccttgtgtgggcacatggagcccagtgacccaggctctgctgcagtccctgtggcccggctgtgagcctgctggcaccgagtttcatcatctcaggtgagcctcccggaagccaccctgcctcctgtgagggcttctccccaaatggccacagccacagaagcagcactacaggatcagtccacgggagaccccaaattccaagtgaaccttctcagtcaagaaaccacagggggaagctgactgcagtaaggggcgcccactttctggtcacgtggagagagagaaaagctgggggcagggactctgggggtacccatcccggtgggccttgcagggcatgcagatgcccacaaactgcacaggcccatccggtctcgctctcatgaggaggtcaaagaggcagcgagccagagtcacctcccggtaaaggcccagcccagggcagttctcagagccaaacagaaaaggagggtgcctgggccgggcgcggtggctcacgcctgtaatcccagcactttgggaggccgaagcgggcggatcacgaggtcaggagatggagaccatcctggctgagatggtgaaaccccggctctactaaaaatacaaaaaattagccgggcgtggtggcgggcgcctgtagtcccagctactcaggaggctgaggcaggagaatggcgtgaacccaggaagcggagcttgcagtgagcagagatcgcgccactgcactccagcctgggtgacagagcgagactccatcacaaaaaaaaaataaataaataaaatagaaaaggagggtgcctggcatgacttagggcctgggaagagtgctgctggtgaccccttaccgtgggcttccgaggcagctcagggctgaggggctctttgcaagtgaatgcacgggatcacttgctctgcagccctggacatgagcggccccgaggagggcagctacaccttgagccagtgctggcctgaagggtgatgagggaggagactggcctcgaggaagctgtgctgcatggaggcagctggcccagaagagtccctcccagcaaccccgacctgtgccccggctgatgccttccaaccctgtctaaccacaaagaacagttgagaaggaaggaaatgttcatggatcagaaattccaaatgtggcctcagggaatgtcattgtgttaagtccactcctgcctctaagaggcaaagaagtaataaaaatcaatcctaagcaaagcgggggccgtgcaggcttgctgcagttagtcagcgtggcctgccctgccctaagcacggcccaagtactgaggcgctggcagaccccactgtcccctcctcaccgctcactggagggcaccacgagctgcggggtgagcccaccggagcttgcaaaggacgaggacctgctgccactgctgctggctgaagccaggcctctcctggggcactgacaggaggccccttgcagcagcaggaagcagagggccgtggggacactgaggcagctgcacaggttccctgcggcaggggggtggggtgttgcctgagtggctcgacgataaatcagatcctgaatggagcatgactcatggccgtgggtgtggccggcagggcgtggctggtgcacgcggggccttacctgccacagccgcaggcacatgggcatgcccagcttggcatctgccttcggcttcagggcgcacactgacgtcttggagggcatctccagaatctgaacctgacagtaagaaaacaagttgatttgggccgtcgccaagtcgagtctgcgctatacaaacaagagactcttaaggcgattagcccgggctgctgtgagtttctgtctgctcccctccccgtgggcacctgggagcccaggctcctaattaggctgcatgggcccttgcaaaacgctctcactgttcccaggtcaccgcctggcagctgccccagcctctcccgacgttaccgtgcaggctgagcaggaggctggttcactggcccctgacagagcccaccgattctctctccttcctggtgtaggctttacatacgaaccagtgtgagtgatctcaggcatagccatggttctaagactcgcccaggagcacctagggatttgccacccacttgagaaatgaatgtgatgtgcgtcctctgagggcagctccgggaaacctggctcccccacctggacgccccggtgtcccctgtgcatcgaggctgcattccaggtcccctgaacacaggccagggcccccctacacctgggctgggagatgtgccatgccggcttgtggggtgtaggctcgctggtcacacatctcctgaacagccaggtcaggggatggccgaggccacaagcagcagactgccaggtggttctgctggaatccaggtccgcctgcaccctctgccctcgctctgggaactggggaggctcagccagcactgaacttccccaggtacaagcgagagcagctcactggcccctgacagagcccactgattctatctcctctgtctgcttctccttcctggtgcatgttttacataggaaccacttggaatgagctaccgataacacagcaataatatcaatgcacagccaccttggacagagcctggcatacatggggcatcacccactttacacacaaggagtccaagcccctgaggctgggggctctgagtaggcagaactcataccagttggtccagcggtctctggcccctctattctcctgagccaggcagagggatcgtgtcttaggggcctgtgcctctgtgggtgagaagcttgctgccctcactaacccacacagaataggcccgggaccccaagtctgaatcccagatctgccacaggcatgctatgggtgtgctgaggtcacctccgggcagggcagagagctgggcccacagcccggtccttccagctacagagacctgctgaggcgcccacctccagtacgcggaccagggccacggcgcttcttgtgcaggctgctcttgccaggggcccccacagcagctcagcctctgccagcagggcttctgctccactcagcaccaggagcttagcctctgacagcagggcttctgctccactcagcaccaggagctcagcctccaacacagggcttcagccccactcagccccagggatggctcacagatctaggccccacacaaacgcatgcacacacacatgcatgggtaacatgtacacacctgcacacacaaatagagcctcctgcccatcaagcccagaaaccaggggcctcagggggagccaaccatctgacgaaaggggcccccggggaacaaacagagcaacataatgaagagggcaaaaaagaactcagtaatgggagaggtgattacagtcaggaaccaagaggctcagtgatggtgagaccaggcctgcgagctctggggaaggttgtcaagcctgaactccaaagccggccaaaatggtaagcaggagggtaaaacagaggtctctgtggacaccaaggattccttgcggaaaaaccgctcaaggagaagctctagccacatggaaatataggaacattgatgtccaaaaaccaagacgaggtgccactgagcctggcacagaagaacgtggagaacccaggagaagctggggcgggcttagccgttctttgtcttctgcaagtaacagcaactccgggacagggttcctcctcttaggatcagcatggccactgagtgaagagctagaggcaccagggcggcctgcaaggaccagagttatagcccatgtgccacctctgtgatcccagctaagggagcagtggcaagctgtcattgggtgttgccaccattgtccctttgctgttttcaggaagggtctgtgagagccaccgtcagggctgtggggagggtctgggagggtgtagaccacactgcctggctcactccccacatttccaaatgatacgggagaggggcagggaagtgctaggaagggaagtcacctggcaagggctccacccccgggcctgtccctatagacctaggtgaggacaggcactcctgccttcgcacccaaatgctgcatttcccaagaccaccctggctcaccacacccccattctgtgcctttaaaaacccccaagaccatagcaagcagagacacaagtggctggacgttgagaggacgttgaggggagcacggtggtggaagagcacaccgacagaggctggcatgctggcaggccatcaaccagcgagcggaatgaggtggaatctggccgggcagttggaggagagcccaggccacccagcagcccaactccaggggaaaaccatctcccttctggctccctcatctgctgagagctacttccactcaataaaaccttgcactcattctccaagcccatgtgtgatccaattcttccagtacaccaaggcaagaaccccaggatactgaaagccttctgtccttgcaataaggcaagggtctaattgagctgactaatacaagccacctatggacagctaaactaaaagagcaccctgtaacacacactcactggggcttcagctgtaaacattcacccctagacactgctgtggggtcaaagcctcacagcctgcctgtctgtatgctcccctagaagtttgagcagtgggacaccgaggaagcgaaacacacctccattgcacgccccgggaggggataagggaacttttcccatttcacaacctgttttccccatattaaattgagaagttttgttttgttttaaagtcagagtctcactctgtcacccaggctggtgccatcacagctcactgcagccttgaactcctgagctcaagtaaccctcccacctcagcctccccagtagctgggactacaggtgtgcggccaccaggcccagctaactttttgcagagatggagtctcactgtgttgcccaggctggtctcgaactcctgggttcctcctgctttggcctcctgagtagctgggactatgatttcctactttttgcactcctctgtgccagatttcttaaaataagatctgttcttcttgtcgctatatcaggaagatgggctagttccagcagttaatggggtggggaggtaggggacttaagccaggggcaggaggagccgccctgagcacacctgtgcctctgtggggtggggagggctgcggaggaggcaggcactggctacacagcctacacggccatacacagtccccaaccaaggaaggcctgtctcaatttgggctccaaaagacccctctggggacagtgaggggacatcaagggcaaaggacttgagcaggccagtgagggcaggggcaaaagatggggggaggaggggtgcggtgagggcagaacccagggcagccctgatgccccactctgggcgctgcaggagggagcgggggtggcggcgccttgaaccacatcctgggtgcaggggagtggtgagccctgggcctgagcaccagaggtacacaccacgtctacctgggctgggtcctcagcccggggctgcccctgcctgcgcctgtacttggagcctcctacagacacccatgagctttccgcctggcacctgactgcaacttttgtttccagaaggaaaaatgttaggtttgggcaagtgtggccacccagccggccgagtggggtgggagtgcggctccctgggcgttgtctgggtgcaggccagtgaggctttctcccgcccagtctgacagattccaggtgggaatgtggaaagcaactgttttcccaggatgtgagaggtccccagacaggctgccccgggaaaagacagatgctgccccacagggagagctgaaagctaggaggagggttagacagccttgagcacaggggacgtgtggcagggggcagcgcaggctgaccgagtgctggctggcggcctgggggtggccgagaccagcgcatggagcacagcaggccaagggaagagctgactcaaactcctgcagcattcctgtgggtctgtagaccttgggtcccgggggaggaagcacgcccctctttctcacataaatacaacttgtaacaggtttttggcagattggcaagaaaagtgtatgtagctcctaattggttatttaaatgcaatgaacaaataaatgcctgttcctatctcattatttctgtactggatctgcctgaagacagaacgactctccttgggcaggggccaagcccaactgtgcgtgggggccgtcctgcccagtaccagccccaaagactgcccgggcacagcgaatggggaggactcggcagtgggcatggacagtagcccccacgtgtgcgccccctattccatggtatgtcctccccatgccccgccctcgggccaccatgccccactcaccaggtgggacagtcgccactcaaaggctcttctctgatttcccttcagctcccccaagagctgagcctccagccacaccctcctccactatgacaccctccccgcacatcttgggcacccctcccttggcagaccctgcctcctgtgccactgggggtgtggataccactgtccagctgggccagtcctgtgttaccaacacctctggtcattctggcctaagctccacctaacagtggcctccctgcttggtgatccccccaccccctgggtgttccctagctcacctttcccctgaggactgtgatcaccaccttgtgcctgcacccacccatcccagccctggttgtgtgccctgagataccaccctccctgctgccctgggtcagccctccccaggcctccaacttcaccagggacttggtctctctcccaccgcctcctgccagctgccccggagcgttcctcccacttgggtctaaggtcctcagggcctgagcagtctctcccctgccgttcctgccggcctcgggcctccatgcttggccatcccacgccactgtcctccatgtgcagaactatgctgggtgcccaggcctccaaaacaccggcccctcccccaacgcctcctgattctcccactgccctgggaggatggctcatcagcaaggccaccccaaggggacaggcccaggcctagccggctgtgcatcagccccggctgctgaagctgccggcaggtgggcggctccatggagtcctgtgggtaggcgcaggcgcctcctaatcaaatgcagaggatgagcacaactgtttggagaacatggggcctcaggcaggctggctctcacctcgtcgctgcccctccctggcacggcaagcgtccagcgtggctggcccccggccaggatgctgctccggcagaagcccacactctccaagcacacggagtccacgacagcgctcctgccctccgcgaggtcccacaggcacagcttcaggtcccggccctgactgccagacaaagaggagacaggcctgagactccccttgacaagtgtcagctcccatggcccctgcagcggaaggaaggcaaggccatgtttccagagagtgggtgccgtgagcttggatcatcgcaggtcgggagcctcagctgaggaagggcctcaccgctctggcattgacacttgagccagcaccaaagtgcccgaggccaggacatgcagtggatcaaggctgtggactgatggctgtccagcgtggccccggggtgggggacaccaaccctgcagtgctgcacagcacagagagcaaacttcactgtgtgcaccctaaaaccagcaaactcccagggtgccaggatcccaggaaggactgcagactgtgacaagggggagaacagaggggagccaacctgaggcattttggggtagtgctcatgactagatgcttatgaggttaaagacaaaaataactgtgcagaaactgttccagtgggtgaattagtttctcagaggggtgcaggttacagttctgaatcctctccacgcgtacacctggtagaacagatgaggaaaccagtggtggctcatgggcccggggtctcaccacagggagatgtgacgaagaggcacaggggagacatgggctggcggagtcgaattagaattgtaaagtcaatatgaacaacgagtgtttgggcagatgcacagacagaaatgagtacagacgggtgtgtaagcacaggtcagcgggcacccaggcgtctcccggtgctgtccactgagaacacctagaagcaatgaccacacctaacccaagtcttggtttcttatgctgttctccaaaaacaggaaccagggctctggagaaatggctgagtctagggtggagtggaggaaaaccaagaggagtctcaagcatcctgtagtgccaggcagtgagaaatgcttcaaaaataaaataaggctgggtgcagtggctcaacgcctgtactcagcactgtgggaggccgaggcaggtggataacctgagaggtcaggagttcaagaccagcctggccaacatggtgaaaccccgtctctactaaaaacacaaaaaaatcagctgggtgtggtggcacgtgcctgtaatcccagctacttgggaggctgaggcatgagaattgtttgaacccgggaggcagaggttgtggtgagccaagattgcaccactgcactccagcctgggtgacaaagcaagactctgtctcaataaataaataaaaataaaataaagactgggtgcggtggctcacacctataatcccagcactttgggaggccaaggcaggaggattgcttgagcccaggaattccagatcagcctgggcaaaatagtgagacccctgtttctacaaaagacacaaaaattggccaggcatggtggtgcgtgcctgtagtcccggctactcaggaggcttaggtgggaggattgcttgagcctgggaggtggaagctgcagtgagccatgatcgagtgactgtgctccaggagaccctgtctcaaaaaataaaataaaaataaaaaaggatcggggatgtcagaaggacacggactctgaagctggaacaatctgagaaatcaaataaatcatggtggtattagattttagcccaaagaaagaagtaaatctgcatgagcccatcctcatgagtgaatgtgtattatgtatcagaaagaaggaataaaccttccttccagcttcctatattccaattaaagtagaaatctgccatggctgggagggatgagggaaacgagaataccccagtaataacaggtgcaggcagagtccacagatggatgctaaaatcagcggcaaaagggtaagggtctcaacatgttgcccaggctggtctcaaactcctcggcttaaacgatcctcccgtctcggcctcctgagtagctgtgactacactccccagatgttagtaattactgcagtggttttaacacagggccacacatccttggctctcctctccccaggaggtgaagcttccttttctctttgcatgtggactgcagctagtaagcaaaagctataccttgacagtggagtcaggcagacacttcctgccccagtgaccagggttgtccccggcaagccatgggccatcagggacccatgtgttcagcatggactccgggatgacaggatgagaaacctcacttctgtgggtttcttcccaaaacccatcaccccagtcttaacctgagaaaatatcagacaaacccaacctgaggggcgttctacaaaacatctgggcggtaactcttcaaaagtgtcagctaggtgcagtggatcatacctagaaggtggaggtgggaggactgctcgagcccaggagttcaagaccagtctgggtaacatagtgagactccatctctacaaaaaatgttttttaaattagtcaagcttggtggcgtgcacctgcagttccagctactcagggggctgaggtaggagaattgcttgagcctgggagattgaggctgctgtgagctgtgatcacaccactgcactccagccttggtgacaaagcaagaccctgcctcaaaaaaaaaaaaaagaccaaaatgttgaggtcacgaaaataagtgatcacacaccaaaagggactaaggagacgtgacagctcagaggatcccggagcagaaatgtcactggtggacaaacagaagaaattgaaacaaagtctgggtgccagttattatcatgcaccatgctctgccaggagggccgtgcggtgtgcggtgtgcagttgcggttgtggtgcccacgccacagagaattcagcaccacaaaggccgatctgggcaactcggtcccgtccaaatctccactggggttttggagaacctgccaaactgatgtcaaaatgtacctggacatttggagcacaaagacgtgcacagcccccgtggctctgctaggcggcaaggctcaacatgacactgcagggaggccgagatgggggtgtcctcagcatggggaggggccagggccaagggaggggaggtgtggctgcacaccacgctcatatggagggcacccatgtaagccctgcggggagtggaggactgacttgtttttccaggaactttaacattttttttctttgagacaatatcttgatttgttgcccagggtggagtgcagtggggtgatcacagctcactgcagcctcaaactcctccctcagatgatcctcccacttcagcctcccaagtagctgggactaccagcatgtgccaccacacccagctaatttttgtattttttgtagagacgagatttcaccatgtttcccaggttggtctcgaactctgggcccaagcacacctcagcctccctaagtgctgggattacaggagtgagccactgtgcccagcttaactttttattttgaatcagttttgaactcacaggacagttgtgagaacggcacgaagaccccgtatgcctcctgctgcagtggcctgcttctcccggcccctcctagccctgtgcacacaggtgagcctctcaccaagaactccaccttgtcaacaccgcatcctgaccaagggtgagccccgacagcccacagccatcctggggcgtcgtggcctgtgtggggcctcgcggggccccggctgcctctgccccctgcatggccccttctctctccctgtctctgcctctctctcatgtctttgcactccttccttccctggggacgaggcccaggcccatattcctcagatgacaccagtcgtcacgctgcgaggcacacgatgtgacctgcccaccatcaggggtgtcaaccctgatcgcctggtcaggacccatagttttcaaaggctcatcatccctaattctgatcatttattttagtgctcaaattggcccaggctaatgggagtccctgcaggctggctcagaatcctctgacgtggccatctgcgagatgtccagacctagaatctgccatctcccggggaaccctcactcagcttaggacacacaggcatttagaagccaggacctgggtgtccacctgctcactgccagagtgtgccccagccaccaggcccctccgcacacgggctagggaacacacacatgcctcacatgcatgcacacaacacacaatcacacacaccacacacctcatacacacctcacatacatacacaccacacaggcacctcacacatacacaacttacatacacaaacctcacacacacaacacacaggttctttctcaccttcccccttctcgtgtctgtaactctcctctctgggcagggacaaccctggcctctgttatcctggagatgttcactgacatgcccaacaagcgagcctgccacctgccctcaccaacctcctggcctcccaggctgccgctgccacaccacccccccaaccctgcttctttgactgcctggcacccccttcccaccccatccaaggggcactgaggtgggggaaggcgggaccgctgggtacccacatggaaacccagggccttcactgcacaccgtagtgaattccagctgaaccatggatctacaagggacaacagtaaagttcctgggagacatggagagaggtctctcggacctcggtgcaggaactcccggcaagacacaaaggcactctccataaggggaaagcctggcagacttgaatcaactccattaaaatgagtaactttgttcattaaagacaccattaggggccaggcacagtggctcatgcctgtaatcccagcactttgggacgccaaggtgggcagattatgaagtcaggagatcatcctggccaacatggtgaaaccccatctctagtaaaaatacaaaaattggctggacgtaacggcacatgcctcttatcccagctactcgggaggctgaggcaggagaatcacttgaaccagggagtcggaggttgcagtgagccaagatcatgccactgcactccagcctggcaacagagcaagactttgtctcaaaaaaagaaaaaaaaacgtaagaaaaagaaaacagcgacagctgactgcagctacatgcaacacacggagctcacggagataaagttgagtgagagaagtcacacacagatgctgctccttatgtctccacgcttccaaagaaaaaagcagacaaaatagtctatgcttttcagagacatacattcataaatatagcaaaaatgaggcgtgaggggctacctcctggggcatgaggggctatctccagggagagcaggtggcagcagctcagggattcagaggctcgggggccctgcgctctacttcttgactggaaggtggttgctcaggtgctcactcagccgtaatacaatgctctgaacacttgtcttgcactcttctgtgagtacattatacttcacaagaaaaaagattaaaaaacaccctgccgaggtggctgtcgaaggcacaggtgtgtccttggcatgcgggaggctgagggcgtcctcccacctcccatcaacatgaaagccatcacttccttcaagggccacttggagagacttggcttccaaacacagctgagcacaggccgggtggcggcccacaggctctagtacagtgcagacgcacctggcactccacacctgcagtttctgtccacagaccccctgacccgtggctggctctgcctgggaagcagccactacagcaccatcccagcaggaaggggaggtgccctcgaacgtcagctcccagaccgcccaccaggcctggcacagctcctgtctgcaggacagcctgataccacaaggcacctacgcaagggaccaccaagggctacattgtggctgaaaactcaggaggacacttacaaacagcagctcctgatgcacatggcctggtggggttctagaaatgaagtctactctgacaatcaaagaccaaacccactctgaggccccctgcaccagtggtgagggatctgggtcggcttggccaggatgcaggcatgaccacacggggctctgcaagcacacaggctcagggcctctgctcttcaggacaaccctggtgccttcgtcacctgcagccatctcccaggtggtaggcaccgcgtgagtctagcacagacatgttttgcagactggtgggggccagacaggcctcattctccagggactatactccacagtgccatgaaccaggcaccgagtccagagcaggagaacaggcctgtccttctggagttctgggctgtgatggtgatggcacggagttccctgaatatgacgcaaggcaaatcccaggacagcagcaggcccgtgctcaggattcctgggctggtggcagcgatccccacacaggggcagatgtcactctgatcaaggacaatagcctgctccagcatccaggcagcccaaaggaggacttgttgtcagccccctgcaggccttccctgtcccaccatgccctgtccctcccactccccatgggaaacagagaagcccctcacgcacctgcccctgtctgctgcttcctggcctacctccggcctggtgtctcagccccatcacctccacaagaccacgggggcgatgtcagaacccagccctgggctaaccctcgggggctgcccctccctgctctgctgccagctgcccagcacccagccccactgtccttcaccacactcagaggcaggccctccagggccgcagcacgtggggtctcccccaccaggactgccaggccctcttattcctccgccacctcctgcttacccagcagctgcaccagcgtgtgaagcagggccctgtgagctgggtaacctcaggatgaggctctgccacccatgcaggaggatggtgcgacagccacaggaggccaagttgtagaggggctgtggtgactgggacctgggcccatgggatagaggcagaagctcatctgaggaggggcctgggctcaatgcggacccctggccagggcgagctctgctgaaggcacaggctgacactgcaatggggacacagccatcgccatacgttcactaggctcttcccagcaggcacctggccagacagcacagcagtcacggagggtagggtcacactgtctcgggatgggctaaggcctcatgaaccatgggggcacccagaaacctgcccttgtgctaagcacaggctagaacagtggggtctgaataccaatggggacaggccacctctgtggacccttcctgctggggtacagtctggacaagtaatccccaagtgatgcgtagggtacagaacacacacgtgagctcggggccctgagggaggagactgcaggggtagaaaccacaggagacactgcaggggggaccaggtggggagatggccctcactaccacgcccacttcagaaacgcagaagcacactgctgtgggacagcactatacacccaagccctgcgccccgcccctggccactcagccaccatcttgccagccacatagccgtatgtggcacaacatcaggggctgggtcctcttgggaagagtcaggtgcattgtcataacctagtgaagggacacacacggccagggctcagctgccggaacacccagctcctagggcctccaccggcaccgtgtgtgacctgccatgctcatggcacacggcccaggcaggatgggcagtgggcagggaggccctccttgggaccactgcctgcatccctgagcctgtacttcatcccattcccctcctctcagcaaatgccctcacccctgcccagtttcccaagccacgacccagtgcccttgtgaaggccctcccaccaacttgcgcctgggctcacctcagatgtcaccagccctggagctctggcctcctcacctggcacctcctggctccagcttggagcatgaagggtccagtggagatggtggagatgcagaggcagacctgcctgcctccctgtgacaaggggctggacctgcacaccctgcccttgctgcggaccctttgctggccccttctggttcccccaccccattctgcccctcagtgggggacaccagagcctccatcagagagttcctgactcccccgaaggccatacctggctcctgcaccttggagacccacctgaggagctggcgcccctggggcagcgtctgcagccaggtcacacactggccgccgtggccatccagggtggtaaccgctctccgcgtctgcaggctccagatgtgtaccaggccactctgagacctgtttcagacaagccgagcagggtgtcagggggcagaagggtgtgctgaatgctctggggccagcctggaggccacattgtgggatgcgggcatctaggctggttgagctgaaaagccaacagctctaaatatgaactaagggccaaactggcaaagcactccttgctcctcttccagagaggggaccgggggaccctcaggagcctctaggggtaactcaggcagatctgcttctctggaggtagggggagccatgccacagtaatgcacgctgggtggtcgtgcctgctcctgcgtctgtaacaaagagtgtgtgtgtgtgtccctgcctcccccaagggacagtgtgtctgctggtgggtgctgaaagctcagcaagcctgggtggcgagcagtccatgccccttggccagcaccctcaaacaagcgctgggctccttgctagctcacgacctcctgacttggccctgggtggcctggggctggggccacagctactcaccctgagaagaggagcgggcgcccctgagcctgggctccttcgcagaagtgcagcgcatgcaccggtgactgggtgcctcggaggacaaactgggggtctggaggtggcggcgggcagggggccgtcatgctgggcaggatgcagttacctgggcaccaagggagggcgtgtgagtgactgcgtccctattctcaccctctaggaaggctgctcaggcacaggggtgcttgagatgttgcccctgctcattgtctctggccctgtgcccctcctgggagagaggtgccactgctccccagacactgatgaacggcctgtggctacagaggcaccagttccctgcacggcggtgagcccagcagagagcacagagctcacccttcccccactgctgggggaactgggagccccatggatgccagccctcctcgcaccgtgcctgttggcctctgcacctgactggtgcacccgcttgggccccacctgagccatccctgagtgggcacagcggcatccaacacttcctcggccactctggcctccagggcttcctgtccaccactggctgtgccctctggctccccagatcccaggggccacaccagtgctttcccactctggccatctgcatgccgggactgccggtcctgccactgggcttggctgagtcccgccctctgtccagggctcactccagtgtctctcttgggagccaccctccctccctgctggcaaatccagtctcccttcttctctcctccctgctgccacctctgcccatggccagctcagggatcaggggaaaagaggcacacagggtcccggggggctgctaggaggagccttcctctcacatctgctgggccccaggcctgccccgccacaatttctaaccgctatcaccaccctataaggcggcagcacccttttcactcttggggaaaccgaggcagagaatagtcactgagctgcaccaggcccctggcgctgaggcctgaagtactctagggcctcatggcaccactgaagggcagagtggctggggcagagtcgccgtgcggctccttaggagagctgcggtcacagatgagcagctgttccccagaccactgggcctgtgggggaagactgccgggccaccacccacccagagaggcttcccgggtccgtgccgagcccttccaaccactcagacccacagggcctcgcactccacctcagccccacagctggctgctctgtggggtggccctggagccagaagcgaccagctccatgtctgtctgcctgcagaccctgagctgggctaagggctcagagggaaaggccaggagcagaccactgggtggctggggcagcctgtcacagggggcctttcccactgggctctgggacagtggggcaggccccggcccagccacctgcagcctgcacacaaggcagggaggatggcccacggcagccacagccagcagagggactggggccagtaaaggaccagggcaggggagatgggaaggactcttcagaaggggctgggtggtaggcggatgggggtgcaggttcagaggcaggagtgctgtggatgtctggaggcagctgtccagggtgccccttcagcagcactgccaccgccaagccctgcctctccccttctgaatacacgccagccctctccttactctattcagagctggggcaaaggttcaaaacacctgagaaatgcccctgccaaggtgtcctgcagagtggagggtggacagcagccagtgcccaagcgggcggcatgggggagggcaggaggcctgggaggggccgggcagtgactccagggcgcaggtccaccctgcctggcgagagacctcgggcagccactctacctcccaaccctgcctctctcaaggggttccgaagacaatgcggagttccctgggatatcctttactaactgccaagtcccatttttccttttcttttttgagggggatgagagaggtttcgtcctctctcacctttggctgaaagccaactgatcatgcccaaacttaagggtggcttccaggggaggcagagggaccagaccccacactgctcccaagacccacggcccctgctccagcctgtgatggggaagactccaagactcctgaagacgcagccaggccgggggctggaacagctgccctcagcgggctggcttggaggacagttctcagaagccactgcctgtttgtgctatgcctgccaggtaagaaaggcaagctagccagggggacaggaaggcagggcccagctccaagaggagccaaagaatgcagacccggcaaaagcacctccacctagcaggaaagcaccgagtccaggatggagggtccctcccatgactccagtccaggaagcagagcctgacaggtcacctctacacaggctcccctgtgcagtccaggcacgaacacacattagacacacgctatgctcacacatacacacacatgcacatggtgcacacagacacatgcaaaacccacacataggacacatgcctacacatacatgttcacacacccatatgtgcacacacacacatgcacacacacaggcacacactcatacctacatacacatacacacacgcagactcagacactcaggcacaggcactcacgtatgtgcacacacagcacagagaagcacacacacagacagcacggcggccttgggcggtgccagccgaagcccggcccccacatgccacctgcctggggcctggcgggagtttccagaacctcaccagcagaaggctcattctcaggtgatgaaatcaagttctcctctattgtttccccagaactgcagggaacaaacccgtcacgttgttacaacaaccaaaatgcacaggccaaaatgatgcatcggcaattaagggctccatcatttcaagtaattaaaataaatgctttatttgaaaactaattaattctagctacatatttttcccatgacaatatcctaggattgcttgatttatgacatctaattattctttattaatctaattgagaatcatcacattcccctatcttgcctggccccaggctgtggagcaaaggccgcccttgcgcaaggcccgtgtgcgcccagctgtccttgcggtggccccggcccagccccggccctgtcctcccggaggcaaaggaacaggaaacttaatccacagagcacaactttggcttctgcctgctcttccaggtgtcaaagtgagccacattctttgaaaaatgaaaggcagtctgacacaatttgtgcaactctaacagcccttccagagaagccacaaacacccctgaaagccccagggaacaaatggacgacaacagcatctgcctgcaatgcaccaccgcggaggcagctcggcaggccccagggctctcccaagaggggtccagagcgctcctctgggtgtggggaccagcgggtaggtgcaactggcagagaggtccacagacaccccactcaagggaggcaggggcaggcctgcaaatgtcctgctggcgcaaacccacccacacctgcagggccttcctccctacagatgaagcagggctgcggcagtggctggagcccaaacaccacaggtccctacccaagacattcttgggctcctgggggttcatgccagacaggcctcagctcagcctgggcccccgccctgccctcgggctgcacagccctgtgctcagtcccctagcccttttgtggaaatcagcaaagagtaccacgaagtgagccaacgtggggagccaccacccagagaggccactggcaccacccctgcccaccccagcccaccaggtcctccctgtcccattgggcatgtgacagcacaaggacaggccgcacaggccgctgggagtgcctcaaacaggaccctctgccccactgcatatctcacacaagggcatggaactagctccagcatcccccgaggaagctccagcccataatcagcaagactgaagactaggtcagcacccctttacaccaggacggacaccctgggtggccctctcccaaaaaacaactaaagatgttgataaaagtttcttagaaggccaggcatggtggctcatgcctataatctcagcactttgggaggccgaggtgggaggattgcttgagcccaggagttcaagaccagcctgggcaacatagggagaccttgcctttacaaaaaataaaaataaattagccaggtgtggtggtgtatgcctgtggtcccagctactcaggaggctgaggtgggaggatagcttgagcccaggaggtcaaggctgcagtgagccatgatcgcgccactgcactccagcctgggggacagagcaagaccgcatctcaaataaattaaataaaataaataactatctttaaaaaatttttttaaacacagccaggcacagtggctcaggcctgtaatccctgcactttgggaggccaaggcaggaggattgctggagtccagaagttcaagaccagccagggcaacatagtcagacccccatctctacaaaaaaaataaataaattagctgggcatggtggtgggtgcctgtaagtccagctactcaggaggctgaggtgggagaatcatttgagcccaagagttccaggctacagtgagccacaatcacaccacggcactccagcctggacagcagaacaagaccctgtctctgaaaaaaatcaaaatcaaaatcaaaatattaaacgcatcactaagttgacaaaaaaaagtctgagctgccagaggccaaacactaagtaaaagtgcagcctcgggagacctgccaagcctgccttgagggcatttgctgcactagtgacctggatttccagctctgatggcctctggggtgacaaaaggcaaagcttagggccatcctatggtggctaacctcctaggagaaccccagtagctagatgctcagtgttaggctgagccagcactaaacctacacccacggatgccagaaaaacaccagtcctcaggtttcagccctaactcacaccaccttgagagatcccccacacttcagtctgtcttctcagaaggaacccacctgcaacccaggcctcaaggaattcactttagaataagtcctaagaagtgcaaggttgtagtcaaaaatcacaaaagtcaacaaggcactgtaatcgagagtcatgagaggcaacaaaaaacagaactagacccacagagcagagcactcgggtatataaggcaagggtgcttaacgctcttaaagaaacagagagggaactgcaactacaagtagagagcaagggagatgaaacatcatcacacagatccaaaaaaggatccaacttggtgagaggtggttgggaaacaggagatgtgtgttgcgccaaggtattactctccaaactgtttactgatcacaaaaggaaaatgtgtatcttcaatggagacatctggctgtcaccactttcaccactgagaaaagctagcactgccaataatgaacaaactggcattgcttatctcctgatgtgatgccacagacatggcaccaaccttgtgtgtccctgccaacaatgctcaacctcaatccagccataaaggaaacaatcagacacatccaggttacgagacactgggcaagactactagcttggactcatcaaaaaggtcagcatcaagagaaacaaccaaaggaaaacgctgggtaacttccacattaagagaccaaaggggcatgatgaccaaacatgacatataaaccttagatcctggctcttagatcagatcctggatcaaaaaaaagggggctataagggacatctgggggatctttgtgggtaatctgaatatggactacagataatggggtgttattaatttccttggaaggataacagtattttatgtagaagaatgtctttattcctacgagatacatccgaaagtatttaggggtgaaatgctataatgtctacaatctgctttcaaatgtttcaaaaaaaattctctcttaatctctacctatctatgtatgaatatataggcagagaagtagtacaaatgtggcaaaatgctaacaactggtgaccacaggtgaaggtgtacaggtatttattttactacacttgcagcttttctgtagatttaaaaccataaaagcatgccagaggggtggagaaagacaagtccacactggactcgtatccagaatatctaaagaacacagaggtcaacagaatacaaaagcaaacaccgaaagaaaaataagcaaaaggcttggacagatatttcacaagcaacgtaaatgtccaataaatatatgcaaagatgtttaacctaattaataatcctgggaatgcctgtcaaaactacaatgtgatataattacactctcagcagattagcaaaaaattaaacagtctgtcaaatgttgatgaagacagaggacaactggaaccttctaccatgctagaaggagcgcacacggaaacgaccactttggaaaacaatctgactccatcttgcacaccgtatgactcggcaaccctactcttagataaacaccctgaagaaattctcacaagtgtgtacaaagaaactcacacaagaatgttcctagtagtattgggtataataacaaaaaccaaaaacaacccaaatggctagcaactgcagaaaggaacacattgggtaaattcgtacgatagaatactccacagaactgaaaatgaatcaactccagtcttacatggatgaagctcaaagtcataattctcatcaagagacatgaagggagtcaaaactgaagacacagacagaaataaaatgttcacaacacgtatctgttcaaggattcattctcagaatttactccttgactcagaatatgtcactcaataagaaaaagagtgtaacacaaagtaattccaaaacgctaaaattagagatgggcaaaaaggtatatggggcaaacagaaacaataagaaagtaggggttgaaatactaatagcagacaaagttgaattccagccaaaaagcattagacttgacaaagacagatagtttttaattcttcattgcagtttacaaaatataacagtttattgccaggtgtggtgggctcacacctgtagtcccaacactttgggaggctgaggtggaaggattacttgaggccaggagtttgagaccagcctgagcaacatagtcagattccatctctcaaaacaaataaaaattcgctgggcacagttgtatagtcccagctatttgggatgctgaagaaggagaactgcttgagcccaggagtttgaggctgcagtgagccatgatcacaccactgcattaaagcctgggtgacagagtgagaccctatctaaaaaaaaaactatatatataacagtttttaatatctatatataatatataattaatctatgtaacagtttttaatatctatgcactatataacagagataccacctctatagagcagaaacgacaggagatgcagagtcacagaaagaagcctactagtgattggagaatatgacatactactctttttcttttttttttttttgagacagaatcttgctctgtcacccaggctggagtgcagtgacgtggtttcggctcactgcaacatctgcctctggggttcaagcagttcttgtgcctcagcctcccgagtagctgggactacaggcacacgccacagtgcccggctaatttctgtatttttaatagagatggggtttcaccccattggccaggctggtcttgaactcctgacctcaggtgatctgcccatcttggcctcccaaagtgctgggattacaggcatgagccaccgtgcccggccataacatactactcttagtacaagtcagatcacgtggacaataagtaggcagatagaagatccaaaaaatacaaccaacaaggtagatactacagatctataatggaactttacactctcataacagagcctacctcttcttctcaagggtacatgggacatgtataaaaattgactgtatattgggtcacaaagaaatatcagtaagtttcataaagaagaaatatttataaataaaattccatgaccacagtgcaattaaattagaaattaataaaataaaaaacaaaaaggtcttatcaaatagaaatttaaaaacaacttttaggtgaaatgggataactgaaaccacaaaaatttttttaaaatgaaaaatactacgtaccaatttatgagatatatttaaagctctgatcagaagaaaagtatagaccaataccagttatgactatcacacaaaaatagtaagtaaaatattagtaaacaagacccaatatcacattaatatacagtgatcaagtggaatttatcctagaaatgcaaggttggttcaaatagggaatttatgaaagccatatactgtattaatagatataatgagaaaaagcatgtaattatctccacagatgctgaaaaagcctttgacaatattcaatgcccattttttattaaaatacgtaaacaaacagacattgatgcatttcttagaggttaaatatatatatatatatacatcccccttggtcctaaatccaacatattattttatgaagaaatattggggacattcccactaagatcagaatgcctgctatctctactaccattcgacattgtagtggcagtataagccaaggcaattagtcaagaaaaattaagtagaggtttataattggaaaagaagacattaaactatcttcctgttgagtatagtggtacacgcctgtagtcccagctacttgggaggctgaggcaggaggattgcttgagctcaggagtttgaggctacagtgtactatgatcacacctgtgactagccattgcactccagcctcggcaacacagcaagaccccatctctagaaaaagaaaacaaaaccatattccagattatacgatggtatacatggaaagccatagaaaatcaatgataaaacagattcaaataataaaaaaaaaacttcaactggtagcaggatgtaaaactaacatagagaattcaatagtctctatgttatttgtatacaataacaataaagagcacatattacttgtacaaaaataataaccagttagagaaaattccatttataccaaagaagataaaatacttaagaataactttaataaataaatatgaaaaacctacatgaagaaaatgttaaaattctcttggaagacacaaaagtagatttgaacaaaggaaaaaggatcctttgttcttggttaagacaattcaacatcaacataaagatgtctcttctccccaaattaatttataaatttaacacaaccccaacggaaacaccagcaagcttctttatggagttagagaagttgatattaacactcacttggataaacaaaaatgtagcatgcacagaaaaacatggggaaaaattagctgcaaaggagctagccctatcagatactaacaggtactcaagtctttaggattaaaagtatagtactcctgtatagacagatggatcagtgaaatagaaagcctagaaataaacccaagtacgtgtggaagtttaatacataaaagaggtggtatctcacatcactggaacaaaaatggttaaccatataaaatcagatccatatcttacagtgaaatacacgagcataaactccaagtggatctgggatccatatgtaaaaaataaaccaagcactagaagaaaacatggaagaactgcattattaacatggttgtggaaaaggtttgtcatgactcaaaatttagatacaacgcctgtaatcccagcactttgggaggccgagacttgaggtcaggagttcaaaaccagcctggccaacatggtaaaaccccatctctactaaaaatacaaaattatctgggcgcggtggcaagcacctgtaatctttgtacagctactcgggaggctgaggcaggagaaatgctttaacccaggaggcgaaagttgcagtgggcccagatcatgccattgcactccagtctgggtgagaaagtaagactctatctaaaaaaaaaaaaaaacaataaaataaaatggataattctgactatagaaaaataaaaatttttcatgcctgtaatcccagcactttgggaggctgaggcgggaggatcacaaggtcaggagatcgagatcaccctgactaacacggtgaaaccccatctctactaaaaatacaaaaaattagctgggtgtggtggcaggtgcctgtagtcccagttacttgggaggctgaggtaggagaatggcgtgaacccgggaggcggagcttgtagtgagccaagatcacaccactgcactccagcctgggcgacagagtgagactctgcctcaaaaaaaaaaataaaagaaataaaaagaaagacaaaaattttagcatttgcatgtcaaaagaaatttaaaaattaatatctttaaaatataaataaacttttcaatattaaggaaagcctaaaaactcaatagaaaaatgggaaaaagagatgaatagacaattcagaaaaagctatgaaaatgcccattaaacacatgaaaagatgttcaaccaaaagcttactcatagaaaaatgtaaattaaaactacagaaaagcttcttgttctggcaggatgaagtaagctcattacagcctctctctcaggctgactgcaactcaaaactctggacaaaatataaaaagcaactacctaaggctgggcacagtggctaacatcattaatcccagcactttgggaggctgaggtgggaggatcacttgaggccaggagttcaagaccagcctgggcaacatagtcagaccctgtctttacgaaaaataaaaaatattagctgggctgatagcgtgtgcttgcaggcctagttacttgggaggctgaggtgggaggatcacttaagcccaggagttcaaggctgcagcgagctgtgattgtgccactgcactcctctctgggcaacagagcaagattctatcccaccccccaaaaaatcccaaaaaacaattctctgaaaacagaaaagtgggcaacagcagccagccgggttttggaggaaagcaaagcttaggacagtgacctacacagagacatgtttcctaggttattcgtatgtgtgttttggggtgctgccctacagttggccctggttgcagagctaccaggcagcagtggctaaaacttggataaaactccaaatttctagatagagatacagagaaaaaggtgcgctacggccccaagaatgtgaggggaaaccctgaaggtttactgtccccctctctcacggtgctgccccagggatggccctgcacacagagcccaggggaaagtgactgagagagaagcttgtctttctgatcaggggaaccaaggaaagggaaccctgcaagatggcaaggggggaaactacagagtggggagagctaaaaaaagttccccaattctgtgaataaatacacagaagcctcaagctcacccctgagctgtgtatacacagggcagacccaaagcagcaccagctgtaagaagggaagtaaaccaacactcaagtctcaggctgagccctgggtggctgatgtgcgagacagaaccaaagcagcatgtcaaaagctctgaaaataaaaatgagattaaaaccacagcccacggagggcgagatggagcttgtgcaaatctaactgggttgactgcctgctagcgccaaactcagctctctctggaggacctcacacactattcaacccaggatatgtctaggatatcatccaaaattattcagcatacaaagaacccggaaaatgagaccaactctcaaggaaaaagccaatttacagatgccaaccttgagaagattcagatgttggaaatatctggtaaaaattttaaagcagctttatgattatgctgcatgaggcaaaaataaacatccttgaactgaatggagggaaaagacctctcagcagagaaatagaaattattttttaaaaaaccaaacaaatacgaatttcagaactgaataatatctgaaaaaaatcaataatggaatgggagatgacagagtgacataaagtgggccaggcgtggtggcttacatctgtaatctctgcactttgggaggccaagacggaggatggcttgaggagttcaaggctgcagtgagctatgatcgtgccaccgtactccagcctaggcaacagagcaagaccctgtctctaaaataaaataaaataggccggacgcggtagttcacacctgtaatcccaacactttgggaggctgaggcaggtggatcacttgaggtcaggagttcgagactagcctggccaacatggtgaaaccctgactctactaaaaaaatacaaaaattagccaggcatggtggcgggcgcctgtaatcccagttacttgggaggctgaggcaggagaattgcttgaaactgggaggcggaggttgccgtgagccgatatcataccacggcactccagccggggcgacaaagtgagactccgtctcaaagagaaaaacaataataataataatataaatataaatataaatataaaataaaagattgagtaagtgaaattattcaatataagatcagaaagaaaaaagattgaaataagtggttagcatagcagggacttgtggaataatagtaaaaggtctaacattaagggcagtggagtctgagaagtagaagagagaaacagatttggacccaaaaattaattgaataaataatgcctgaaatttcacaaacttagagaaagacaaaagcacatatgtttaagaacatgatgaaccataaacgaaccataggataaattcaaagaaaacaatattgaaacatcataaactgctgaaaaataataatgaaaccatggaggccagaagggtggaacatctttgttaaagaactgaaagaaaacaactctatatctagcaaaatattctttggggatgaaggcaaaataaagattcccagatgagggcaaatgagaatttcttgcctacagatctgcactaaaagaaatgctaaagttcttcaggttcaaaagacatgataccagaaagacatgtggaacttcaagaaggtaggaggagcaatggtaaaatgcggttttatcacttcagtaaacatgtatgattgttaaaattgtattatctgttgaggttttcaatatggcagttataacataatggaggagggtaagggacctatgtggttgtaagccttctatattttatttgaaatggaaaaatattaactctaagaagactgtgaagggttaattaagtatgtacactgtcatccctgcagcaaccattaaaaacataacacaaagagatactgccaaagttccaacaaaaaatcaaaacaatgttttaaaatacctaaataattcaagagaggacaggaaagaggggatagaagaaaaaaaaagaagagaagaaaaagagaaaacaacaaaatagtagacctaaatataaccataccaatcactacaataaacataaatgctcccaacatgctaattataagacccaactataagctataaaaaataaaaaggtgaaaaagatatgctatacaaataataaattgcagtggatatattaatatcaggcaaagtagacctcagagtgaggaatattatcacggacaagaagaagatacaatgataaatggcatcgattcagaaagaagacacaaaagttgtaaatactgagctaataagagaacttcaaaatgcatgaagaaaaaactgatggaactgaaagtagaaatagataactacataattataggtggagacttaaactcctccttagtaactgactgaacaagtggtcaggaagtcatacagaagacctgactaatactatctacctacttgacctagttgacatttatagaacatgccgctcagtagaagaaacacattcctctcaaatgcacatggagcactcatcaagataggccatatcctgggtcataaaagaaaccttaaaaatgtaaaaaaaaaaaaaaacaaacaaacaaacaaaaaaaaaacctcacgcctgtaatcccagcactttgggaggtcgaggcaggcagatcacgaggtcaggggttcaagaccagcctggccagcatggtgaaaccccacctaaaaatacaaaaaattagccaggcatagtagcgcacgcctgtagtcccagctatccaggaggctgaggcagaagaattgcttgaacccagctggcggaggttgcagtgagtcaagatcgcgccactgcactccagcctgggcgacagagcgagactctgtctcgataaaaaaaaaaatgtaaaaaaacaaagtatacaaagtatgctctctgatcatatggaattaaactggaaatcaataacagcaagataatgaaaatctccaactatttggaaattaaacaacactgttttatataatcaatgggttcaagaggaagtcccaagggaaattagaaaatatctaaactaaatacaaatgaaaacaccacatatcaaaacgtgtaggatgcagctaaaacagtgcttagagggaaatttacagcattaaatacttacatcgacaagaagaaaggtctccaaatcaatgacctggtttatgccttaagataacagaaaaagaggacaaagtaagcccaaaacaagcacaaggaaggaaataagattagagcagaaataaatatttttaaagaatagtaaaacaaatgagaaaataaagcaagaggtcggttctttaaaaagatcaataaaactgataaatctctagctgaactgacaacaataaaaagagaagagacaaattataataattaaagaagggttatcactacagacaccagaaacattaaaaggataaggagatactatgaacaactcaaataaattcaagctaaataaacctagctgaaatgaaagttggaagacacagactatgtgaagaaagagaagacctgaatagtcctgtatcaattaaaggaatcacatttttagtttaaatccttggggaaaaaaaaaaatcaaaattccagcccacatgactttactggcaaattctaccaaacatttaaagaagaaataacactattctacaaattattttcccagaaaacagaaaaagagagaacatttcccaactaatttgatgaggctagcactaacccaataccaaaaccagacaaagttagtagaaagagaagaaaaccacaaacaaacatatttcatgaatatagacatacaaatcctcaaacaaaataatatcttgctgcttaagtctcaagttggggagggaaaaacagcaaatctaatccaacagtgtagaaaaagaatacactggagccaactggcatttatctcaggaatgcaaagctgattcaatattcaaaaatcattcaatgtaaactctcatgttaacactaaagaaaaaccacaggatcatataagttaatatagaaaaggcactgggcagaattcaacatccattcatgatttttaaaaaaaccctcagaaagcataatccataagataaaaaacacaaattcaccttccacaaaattagaaacctttgctcttgaaaagagattttttttttttttttgagatggagtctcgctctgttgcccagactggagtgcagtggcgcgatctcggctcactgcaagctctgcctcctgggttcacgccattctcccacctcagcctcctgagtagctgggactacaggcgcccaccaccacacccggctaattttttgtatttttagtagagacggggtctcaccgtgttagccaggatggtgttgatctcctgacctcgtgatccacccgcctcggcctcccaaagtgctgggattacaggcgtgagccaccacgcccggcctgaaaagagattattaagaaaatgaaaagacaatctatacagatggggaaaaatattttcaaatgatgtatatggcagataatttatataccaaatatataattttcaaaatccacaaggaaaacacactcacaaaataaaaccactaagaatgggcaatagatttgaacaaacacttcaccaaagaagatatgcaaatggcaaataaggacatgaaaacatactcaacatctttagtcgctaggaaaatgtaaattaaaaccacaataaaatgccattacctacttatcagaatggctaaaacagaaaagactgaccattccagttgctggaaagcttatgaagtaattgaaactctcatacgctgctgatgggattataaaatggtacaaccccttgggaacaaagtttggctatttctttaaaaaccagtcacatactggagacaacccaaatgcccatcaacagcagaagaaacagagctatatccacacctggatatatccatccttgacaatgacaaagtaggaagtactgatacatgctttaatgtgaataaatctcaaaataatcatgtcaggtgaaagaagccagaaaaagagagtaaattctgtgattctatttatgcaaaattctaggagatacaaactgacctacagtgacagaaagcagattaaagggaacctggagaagagaggtgcagggaggaagaagggaggggcatgcagagacgcaggaagatactttaggcacagtgggtatgttggttgtcttgagcgtggggatggcgtcacagacgccgcacttgtcaaactgtccacttgaaatatgtgcagtttattgcatacgcaatttaattgcacaatctatttttgtgctcattaaaggaaatgcaagagcaactaaacaatccaattaaaaaggcataaaagatttggccaaacactccacctaaaaagatgtgcaaataagcacaaaaggcaactcaacatcatagccattagggaaatgcaacttatgcccataatgaaataccactacatacctactagagtggctaaaattcagaaaaaaactgtcaaaaccaacaaaaccaagtgctggcaatactgtggggcaactggaaccttgttggtgaaatgcaaaatggtgcccacactctggaaaagagtatggcagtttcttatttatttatttttttatttttatttttattttttttttgagacagagtctcgctctgttgccaggatggagtgcagtggcacaatctcagctcactgcaacctccgcctcccaggttcaagcgattctcctgtctcagcctcctgggtagctggattacagacgcctgccaccgcgcccggctaatttttgtagagacagggtttcaccatgttggccaggatggtcttgatctcctgacctcatgatccacccgccttggcctcccaaagtgctgggattacaggcatgaaccactgtgcccagcccagtttcttataaaattaaatatgcattaacatgttgcccaacaattctactcctagatatgtattctagagaagtgaaaacttatatgcaaacaaaaacctgtacatgaatgtttatagtagttataactaaccacccaaaacagaaatgtgaaaactataatctcctaaaacagaaaataacccaaatgaccatctatggatgaatggaatactattctgcaacagaaaggaacaaactattgataaatgcaacaacgtgggtgaatctccaaagaactgagtaaaaggctacacactatttatatggcatcctggaaaaggcaaaagtataggtacagaggacagaccagtgactgtcatggatcagaaggagggggaggggatcactgccaaagggcagcaaaaggcagggttttgagagaatgagaagttttctgtgtcctgattgaggtggtgttgacacagacatgggttaggactcactgtaagcgcacacaataataaagataataacaataatacagtagttccaccttatctaggggggatgatgaatgatgatgatgaaaagtatctagggatacttttcaagacccccagtggatgcctaaaaccatgaatagttctgaaccctatatacaccatgtttttccctacagtgtacatatatacctacgggaaagtttaatttaaaaattagagacaggcacagtggttcatgcctctaatcccagtactttgggaggccaaggcaggaggatcactgagcccaggagttcaagaccagcctgggcaacacagggagaccctgtctctacaaaaaataattagctggggcagggcacaatggctcacacctgtaatcccagcactttgggaggctgaggcaagcggatcacctgaggtcaggagttcaagaccagcctggctaacatggtgaaactctgtctctactaaaattacaaaaattagcccaggcgtggtggcaggtgcctgtaatcccacctgctcaggaggctgagacaggagaatcacctgaacccaggaggtggaggttgcagtgagccaagatcgtaccactgcactccagcctgggcaacagagactccgtctcaataataataataataacaataataataataataataataagccaggtgtgttggcacatgtctgtagtcccagctactcaagaggttgaggtggtaggatcacttgagcccgtggagtttgagactgcagtgagctatgctcacaccactgcacttcagcctaggcaacacagcaagatcttgcctcaaaaaaaaaaaaagtatactatgataaaagttatgtgaatgtggtctctctcttacaatatcctgttgtattgtactcacctattttcagactgcaattgaccatgggtaactgaaacctcagcaaaagtgtagatgagaggggagctagtgtcgtaataaaatgcccatgagtccacactgaggtaaagaaatgactaaataaacaaatctcccaaacagaagaattccactttatgcagacactctaccatcaaggaggagtagataactcccaaccgtttaaatatgggttatgcagtgactcccttcctaagaggagagtacggaaaggagagaaaaacagccactttacagcagaaacacctgacagataccacctccgccaggtgatgacgctcagcatcagcagggctaggtcatgctgaccacacgtcccactgacatgatagaaaatccaggaatgggccaggtgcatggctcacacctgtaatcccagcactttgggaggtcgaggcgggtggatcacttgaggtcaggagttcgaggccagcctggccaacatggtgaaatgccgaccctactaaaaatacaaaaattagccaggcatggtggcacgtgcctgtaatcccagctactggggaggctgaggcaggagaatcgcttgaacccgacaggcagagattgcagtgagccgagatcgtgccattgcactccagcctaggcgaagaagcgaaactccgtctcaaaaaaaaaaaaagaaagaaagaaaaagaaaatccatccaggaatggcattcaacctttgtgcttttcttcccaaaacccttaagctcagtctaatcgtgagaagaacacaacaaatcccggtggaggaacattttacaagagcctgaccagtgctcctcaaaacttaaggttatcaacaacaagaaaagtctaagaagttgtcctggccagaggagcctggggagacaggagagcaaacgcagtgtggggttctggatgggattctgcaacagaaaaggacattagggcaaattcaggaaccctggatgaagcctggactttggtcactaacaatgcatcaatcctagtccattagtcatgcgcagagcaagatgctgacaggaaaaagggctcagaaatgcgtccgtgcacaaggttcacactcaaccactgctcttggccacagtctcacaggttatgtttcaaataaaatatattgtacaagattcttgtgctattttttcttgtgttacagttaatggtatttaatttacactaatgtattatgaaacttcaattcctgtttctggctttggagtcaatttctatctctactcaaggtgacttaaacagacttaatgagcctgggcaacatagcaagacccccatctctacaaacaaataatttaaaaaaatcggccagttatggtggtgcccgccatgatagtcccagctatgttggtggctgaagcaggaggagaggatcacttgagcccaggaggttaaggctgcagtgagctatgatcacactactgcactgcagcctagcctaaagagacctgcctctaaaataaacaaacaaaacagacttaatgtcaacttttacacgcttttcccattccaaataatttactatcttatttttgccctaatataaattcatcaacagtgccccctggtacaagctagtagttattcggttaagcaaatgagctgatgacttttatgaccatcgttacttccagaaggtgtccccagccagctggggacagaaagagcactgatctaaccactgttgcgcttcaccagcccagcccacctaatttctctatgaagtagcacagccgttctagcatgaagatgttgaattggctggtcctccaggccagcaagaacatgaagccaaggccatgaggcctgaggcaggcacacaggtggctggtgaatgggctccctcccacctcctgctcatcaggcacctcccaggctacacctggaaccagaaaggcactccctggacaggcctgtcctgagcagagacctcagtgtcatcccctgccttcctggtgaggaagacagcagcagtaaggcccagaatctcagaactgtccgctgcattgcagcctcagccagcgaccctgatctcccaaaaagcctcacacacaccactccaagaagctgcatcagacacagagccctgggctatcccagtcagttcactggcacacatctcagtgctgctgcttcaaaccaggaaactgaggtctagatacacccttccccatctctgaaatgcagggagatcagcggggagtcagtgggggcagtcagagactagcccccaacaacccttctcagtcactgatgtctgcccaccaaggcctcgggggccaggattgcttccatggccttggctctcagcccaggacgggggtgggagcagcctggtgagtaatgcccaggcccccaagaggtggtcctgccataaataatgccaaggacacatcccccttcaagggaggccagacctgccagggagggctgcagaaaagctgcactctagctgcaaacaggaagggatgagcctgctcagatggtgaggtccctatcctgttacctgccactcacggccacaaaggaccagaaaccctccctgggcaaggaaaacatgctgcacctccctgtttggacccacggctaccagggccagctactggagataccaggactctgctagtgtcacctggcctgggaaggacctaagcagctcaagctggccacacagcagccacagccctggccatggcccccacctgcccactcccactgcagccagctccctgtcctgagcacgggaaacaggtctaccagcactaactcaaacttcacaaagaaaccatttctggaatggggctccgtttggcgattcggagtcaaaggcgcacttcatagctcctttccaaatcccgtgcattgtcaggccctgttcccctttgaagcctcgctgagtgattgaagcgtctactttctgaggggcagatagcaccgggctggtaatctgactctaagccacgggataaaggtagtttgtttcctctcagcccgtctgtcaacacctcctcagtaattagccctaattattacagagggccagcctcccattcggttattaaatcagaaatagtatcacggctgggcatctgtcaacgccccgactggcgaccttcgattcattgaatcctctgtcagtatccgcctttggaagcgcccaggcgggcagggaggcagcggcttcaaagatgcagatcccaggaagaattccggtgaggcagggaggcagggagggccggtgcccagcagcccgatggcgagggggagccaggcaccgccccccgggcagcaagtgcacagcccaaccccagcaatttcccacctcccagggctgaccgatgtcagtctctctgtggcggggaataaggtatgccccccaagaactccttcccttggagaagaaagcacctccaggcctgcatcaggcatatccgtctcagggagtggccctgactgacaacttggcctgaggcccacaaagccctgaaccagctcagtgcagggaggggaacccgagccccggctgcccagagcactggtaagctggcaaatctgcaaagcagaactcagattccagccatagacacgatttccatagtggagatgagagtgctacagtcctgtaggccccgacgaaggacagccacccatctcccttctgggtctgagtctgttctccatcctagagaaatggtcatttgctctgccacaggggccttctgctctggcaaagcacctccaccctgctcccctagggtatagctgccccccagcaagattcactgcctcaggccaggggccggcactgacctcacctcacctggggcagtggcccaggtgccccagggctggccaccagcacttctccagagactgagacccacagtgccccacccaggactcctggcctgcagtgagccaggtggggcccagcacggtgcctacatgctgaaccccaccaggtctgtgccgcccccttccagataggccctgctgcgtgtgagggagggtcccagagatcagtcacttttgctggggacacgcccaaatggcgtgattcgttcccgagcagagacaagcaagttcctctagacagcccactgcagcctgttctcccccgaggcactgccagtccctgctgggtgctctgccagcactttgggtcctcgtggccaccaaccacccaccacgctggcagggggagtgggtctcatggagacaaggacatggattagttttcttccttggggatgcctggaagcctcatggctggggcatgaggagtgacctgctggccagctccacagtcagcaggggcgccaggcaggcgctgaggctgcaagtcagacttctcctttgcactgggacacgggctgcctcagctgagccaagaggaaatgccagcgtgaggagccaccaggctgcagaggcaggcaggatgggcaggcggggtctctctgtgagcaggcatctcacgctgtggctggggatgtccgtcgccccaggagcgggtcccaggagcctggcaagatggcaggaaggaagcctgacttggacattgttagccagcctgccccaggcacttacgggcagaggcaggaacccagccagcagagggaccggcctttttgacccgggtgaacacacggaaaagctcactgctttacaggaagcgtgacatccccgtgcaccagttcagcctctgctcagaggcctggttcatgtaggccagctgccgatcccatcagggagagacaacactcacagagggtgcaggatggggaccaatcccctggggctggtgcccctggcctcggggatggggatgtgccctggaaacttggtcggagctggaggaggggtccctaagcaagctggggctgacactttctgacagggacttgcctgtgtggctcctcctgtggcggaggcaaccttgggtggaaaggggaggtcccctatcacacacaggtggtggtgtggccaggtgtatgtctcatcaactcccgaccacccagctgcatgcagtcagctgtgcacatgcttacatatgcatgccagcaatgtgcttgcccacatccacagacatgcgaatgaggacagaggccagcctcccactcgctctgccctgtgggtgctgcaggtggacccctcactgagggccccccctatgcacagcctgtgaataaagagccctggctccacaacccacaaacactccccagtcccctgcagtgctcagacacagaggtgaggtgggcagcgcaggcacagcagggggcaggggagtcagatgtcctgtgcacccagctggcagccccaccaatggggacacagaagaatgtggcaagtgcatgagcacccatcatccacaggccccagccctgtgctgggggtggttcctgaggccaggaggaaaggagccggccaatgagaacaccccacaggcctgggctcttccttggccagcccctacccaccgtgtccctgtaatagagatgatgtagcccaaagaaaaactaagggagcaacgggccctgctgtcctggagagcaggcttggccaggctgtccagcgacaaggcacccccgaggcctgcaccaggagagtgtgaacactgctggggctgggcaagggccatgacaccatcctcgctgcctctgcatttgtgatccaatgtgttttaaaacttgcaaagacaacttgaaaaatggggacatggatggtttccctatgacataagcaagacttaaaagctagaataactagtaagggacagatcagaccagagagcaggcgggtaggccaggcatggctcacgggtggctgcagccagactgtgagttgctgcagccagcagctgatgctgaggtaggccctatggaaaaaggtgaaatgggatcccctgttggtcaggacataataggttatgctgtggaaaacacaagccccaaactcagtggcttcgcacatcaaaaatttatttcttgctcatattacatgtgcatcgcggtcggcagaggggctctgctcatcacaggctatcaaggatgacagcagacccctcccttctgccgcagttacacttacaggtggactcaaggttgaatgtcaaaggcagaaagttacaacctgggaatacaggataatgcctttgtaccccccaggtagggaaagatttcttaagtgagaaacagcatcccatacagcacaactgggcactgcctactcaacagccaaggcttggccatccccactcctcagtatgggccccagaacccagggcctgggggactctgcacacaggcatgtggagaccacagaagcctgcccaatatagcgctgccaggaacagcaaagacaaaaccagagaagcctatcgcgggcaccgctgtgggcagaactatgtcccttcaatatttttatgttcaagtcctaacccctagtacttacatttgaagacagggtctttaaagaggtaattcagggttaaatgaggtcatgagggtgggccctgatccaatagactagtgagcttatgagagattaggacacagacacagacagggacacggcaagaagatggctatctgcaggccaaggagcgaggcctcaggagaaaccaaccctgcccacaccttgatctcaggcttctagctccagaatcatgaggaaatgtctgttgtttaagtcccctagcctgcggtcctttgtcaggcagccccagcagacaaacaggtatgttgccctgggatggatgcaggcccctcccatcctcccatcctcagcagcaccaaccagccccacgctgggtggctgcttgtacttctccatactgagcaccccagcccataggatgatcagctgctgccgtcctatggaactcaggtgtggctctgtggcttcctttggccacagaaatggaagtggggtgacacacattacttgtggcctgctgtggcctttcccctgcctcagtgagcatggagaaatatgtccaggtaggctgtcgtcagcacaggtctgacaggccccagccacggtggcccacaggtgcaagcaagaaataagcagtgccaactgtagccgctgcgctgttggagatctttgttactgcagcacaatctggctcatgctgactgatcctgcagggtaacagctttatttgccttgctcctttattgctggatctttgggcttttccagttctgctgttcaaaaaacagtgacacccatgaggtgggtgttagagggcccagaccccagccaaggcactgcatgggcatcattctcattcaacccttctaaccaccccatgaggaaaaactctggtcacagctcaaaaaggtcaggtaaggaccctcagctcatgcggggaggggaggaggcaaggccaacctccagtccctgctctaaacccccatgtagtggtaccgaaccatgaccacccctggcaagagccttcatgcacctagcaagtagtcacagcatgcatgtgcctagaattgttacgtggtcaaattatattattgtgtattcccaccaacagtatgagaaggtccacttctccatacctccacaactctgggcatctaaaacttttaaaatcctggaatcataggcaaaaaaaaaaaaaaaaaaaaattcacccatattttcctctagtactttcataattgtaacattgaaatctttaatctggaatatgtactggcataaagagtgaggcacatacatggctttactattttccagagggccaactgcttttactgaataatccattttactcgttaattggaaacacctctagcctgtactaaatttccatatttatttggcccgtttcaaagtcctctattctctgctcatctgtccacatctaagtgctttaactattgtggctttataaaatattccaatatcccataggaccttatccttagtacttcctattttaaagttttccttgcagacaggtactttaaataccatctcacagcacccatcatgtcctatcttcaggaaataaaatctctgggtatttccaagggaagtgaaggactgacaccatgattagaaagcagagccagcaccatggcccgtccctgagcatgtccagcaaaccctgccaggctctgcagctcctgagcaccctgccttcgggtctgccagtgtgtgggggccagaagagaaaaacaacccagggggaatgcctccttcccccagcaggaaagcagcttggtcatcatctgtctgaaagcaggtgctgcagcagctggcaacaaagccactctgaaaggagctgtgtgcactgcctgtctggaaggccatgccagagtccatcgttgcctccaccctacctgtgcaggaaacctggacatcaccacttcaaggccctaccttcctttctgggcagagcccaaccacaataaacaggacgcgttttaattaaaaaccaggtcacctggactctcccaaggactctcaagcctgcctaggtggatgctgcatgactggccctcagacacacggcagaccataactcacacacccccaggagctgcctgggtcccaagggcacaaaagccccaaagccccaataggacagggttcaaaagagaaggcagcaatcccaggctggagtatccacttcaggtccactaaagggagatggggaaggtggcctgtccagaagcctgtgggacagggtaaaggtcagctgggtgactaggctgtccatcctagagagcaactctgggttctactgccagacccacaggtgagccaggccacagtgcactggaggtaggcatcagggagcagtctgacccaacccacaaaaggggggatggggcctgagtcatcggacggagggcagctgtgacctggcacagaagcatggggctgggccaggacatccagggacttctcacatctgaccagaatcaagactgaaaatgggtttcttctgccagctcacttgctttgctaccagggctatacctgctttctaaaaatagcttcccacctatttccaaggtttccagttgttttacctacaaggtatctgtgccctgaaataactcacacataaaaccatctgaacccagagccttttctagtgatagttaccataaaataatcccaacaatttatatttttctaaataaggtttttgttttttgttgtttttttttttttgggatggagtttcactcttgttgtccaggctggagtgcaatggcgtgatctcggctcaccacaccctctgcctcctgggttcaagcaattcttctgcctcagcctcccaagtagctgagattacaggcatgcaccaccacacttggctaattttgtatttttaggagagatggatttctccatgctggtcaggctggtcttgaactcctgacctcaggtgatccacccaccttggcctcccagagtgctgggattacaggtgtgagacactgctcccggccagtttctgaataagtttaatcagatgcttgctaattagtttttcctaaaatagttggctgtatttccaattcacatttctgctttttcttcctactttccaggaaggtgttgttttgttgttttcacaattgtaaacctgaaagggacttgaacttcttgtccaagcaccagagtgggcacacactgcacacactgggcggctgtacctgcctatcctgtggtaaacttggctccaggagcttccaagctcagcttccactagaaaacccctccttgtgtggaacaggtctttcttcattccattcctctgggcctggggcctcacagctctggactgctgcctggtcctcacttcacctacagctctcggaagtcagttctctacctgcagagccacccaccccctactcagccccacccagcttctttgatcagacccttggaccctcaaagcccctgccagaaaccacagctgcaatgctgacctggaatgctcatggccaggcctctgctcctgacagaatgggaaacaaagacttgctggtaggcagccactgcaccacctcagccagtaatccaacacgtgtttaatgagcaccaattgtgtaccaggccacagagctgactaagacagagcccctgtgctgagggtcacagtctgccaggagggagatccaagtcatttacacactagggcttaagtgctgaatccgcaatgcatgcgagtgcggagtgagcaggggatggcagcacagcagcagggaagaggagcctgcttcagaacaccaggcacgattagagctacagtgttaacacacaaagggcgaatgcctgcagctgagcctggcaaggggcttgcatcccaccttcctgcatccaaaccttccagctgcccagaactgctggtaatcccacaggaaacatcattctttgccaagatgctatcccactcatcccccagaatcaaagtggccacttcctccaggcagccttcctcacattccagctgggacagaagtcacagggagcagagagggtggggctagggggacagacacagaaaccccatacaggaacgaggtcccaacagggcagacgtggcagacccagttcagtcccagccagtgtggaagacaccaaggggggtgttttatgggggtggaggtgacaaagatgatgcaactatctgctgagagttgatctacaaaacgaccccctcgtgggagcaggcctgggtgagacggcactcccagaagacgggcagggatgcagcagagagccagcagcagggaaagggcacagggcggaggtcaagctctgctggagttgggggagctggttctgctcagcgcagagtccaaaacaagcgcatcttgcccagctatggggtctgaagtcatctggggacaccactctgctctgactggggactatggggcgctcaagccacacaggccacttcatcatgaggggcagcattgttcccacctgggctgtgttcagaacccaggagaaagtggtggctctcctggggtctccggggcctccaccacctcctgtggggtacctaaggacacctcctggtctccctctgtctccaaaacctcctcctctgttttctggggttttggacctcctggatgagctgggtctggtctctgggcaggaggattagctgactccgacagtctagggacaggtgtgggggctgcctcctctggctgggaagaggctggttccacaggaccaggcttggagctacatgtagaactgggcaggactgggggctccttgggcccaggggtgctctccttggtcagctgctgctcgaacagagcacttctagatacagagttggacccagacacagcaggggtggccatggcggctggtaaagacctgggggcagtacccatgtcgagtgccaggccctctaagaacctagctaagtattgcctcaccacaggcagctgaggggccactggcagctggctggaggccaggggcaggggacaggtaaccacagcatggtactcagcaaaactgttcgggtcttgaacaacttccttgagatcctggcagaagagctcgtaatcgtcaggcaggggcaggtccccatcaaggtagggggctgcccaggcctgggctcggcctgttaggcgcctgaggatctcgcagacacggctgatgttgtcctgatagtgctcaaagtggaaggacatgtaatcgcccagctgggccaagaagcggtccagtagccacggggagccatcaaaggtgcctgggtctgagcctggtacccagcagaagtccaccctgtggggtcgggagctgggcatgtgcccagctaggggacccctttctgcaggtttaccgccacaagtgccactagctgtgctcttctgctccatggtcgttcgcacacacacggtgtccccacagcagggccgctcaatccagggatccacaaggggggtgtatgccaccccaggagacgccttgtccatctgctgccatggatgtgcgttggcataattggcggctgcccagatgggaatgcgagggccctgctgacggcaccggccacgaggcatgctgggagcacaggggagaagagaggagagccagcactggtgggtggtgggggtgtggacagatgtggcttgcacgacacaacaggacagggatggctgaacagggcgtggcagacccgcactggtccaggcaagtgctgaggatcagggagctgacagctgcagcctcaggagagctgagaagagctgagagactgtcagtcgcaggccatcatccgaggcaatctgtccaaagacaaggtggggaagagcaggaactaggcctaaccatcacccactggactggtgggaagaggctacaagcgggcaaccctctggtacccaactaggagctttgaatggaaggaggggcccagggggctggcctgggaggtctgaggtgggcaaatgctgcctatgacattgcaagggcaaggcagaatgacagatgctgtcaatttcagaagaaaaggggccagatcagaactgtcaggaatttcaggatagcaatagtagtaacctttcactgagtgccccatttgtgccacctcccccacaggaggttggtactagcattgtctttgaggcacacagtggtgaagtaacttgtctgcagccacacactaacccataagtggtggaagcagcaaaaactggctggagagaccagaggcttaactactatacagcacgcgattataaactacatttgtctgctgagtaggctctagccgccccaaaaactctgaacaacgcacagaccgcgtcgtcattaggctcttttacatcccagcaccaggcacacagcaggtcctacctgcttccccgacagagcagtgagcctgctattctctgctccctcctgaccccacatgctttccaaattcacctctcacaactgagtgccacctgcaggcaatgccacccccacccacaaacaccacctttccacagtccccatcccagccacagcagagcatcccagcccccaccattgtaaaatcctggaaccccacttgctgtctgctcccgccactccagtcacttgtgcccagggtctggggagtcccagtctgatggctggacccgcccctccttctccacgcagcagtcacctaggaggctccagagccagtagccagttctattccagtgcaaggagccctcctgtagggctcttacactctgcagcctaactctatctagccccctccccagtctctctgcaaacggaggcccactcacgacctccaggaaactctctgcttcaccccacacacaaacgccaccggctcactgggagcacaaggcctgcacacaccttcatcccacatctcctatctgctggccatcccccctcagggtgagttcctccaggtacctcccagggtggcctgcagcactagaacctgccagggccactggccctacctccaccacccaaacactctggaatccctcaggtctgacccccctctggggggggggtcttcacctgaaagcccagcccatgaccctggcttcccaccttactgcaggattatactaaggcctggacgtgagtcgagtccagtccagtccctcactgagctctaaaaaagcagtgaccccgatccagggcccagctcccaccaccagccaaggttaggtatccaggttgcccacaatgaccacaccccatgcccgggagccacagtgtgctacccagatctctgccttcccttcttcccagtcccctaccctgcccactcacctgcgcacctgtgtcccctgcagtctgggagaaggcttccctgcaccagccagccaggcctgctttgggcctgagccttcctaaccctgggccgcactctcaccattttgagaaccttagccctcccacgcctatcagtctgttggtccccctacttttctccccacactgcctggcatagaagactttcggcccttctagactggacagcactatcctaaaggggcaggtaccacggcgcatgtgtgtttgcccccacaaggccaaaggcagcacctggaacgctggagccgttctctgctctggggagacccaggagccccaagaacaaaacctgcccaaagccttaaagcaagctgagtgcagacgactgcaccgcccgccccccagcaaccgccatgcaggaaatacgagctcacaaggcccacggcaacaagaagcccacccacctgaggctacgcgaatcgcccgcgaagagggtcctgggatccgtagccacagaccgtgggacgggcctccctctgagggcgagagtccaggcgccacctagaaagtggagaacgagatcggccgccgtgaggccaggcaaggagcgggcgcggcttcccgagactgcgagaacggcccaaatgtctccaggtgcccccacaaacccccggcgcggaccgagaaactgaggcccgcagaccgaaggcactgcgacccaggctggggctccgagtgcccctctgcggatcagaagtcgggaaaagacgcaggggcgcagctccaggcccgcgtgcacggagttcaagccggccgcccgggctcccgcctccacactgaccctcttgccggagtcgggaacgcctgctcctaggagcgccgcgcagcgtccagagaccgattacatcgcgcagccacgcccccagcgtgcgcgcggccgccgtgtacgacccggcgcatg

SEQ ID NO: 1051 - DNA, 1232 bp, Homo sapiens
agtaagccgggctgccgtcttctcgccatgggctccggtgagtctggagtccggtcgggcccccggctgctccctaggccgacccgggttgagaggagctctggtcgtttggctgcagctgggagagacttgggtcagacttagaggggacttccagccggcgtgcggggtggtcagggtggagaggctggcgggctaccgggacgccgggcatcaggggctggatggagccgggccggcagtctgggtactcagagatgtcgcccaggtgcccgccgaccgctcggcttactgcggcgcttcccttgcagggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctggtct

SEQ ID NO: 1052 - DNA, 1293 bp, Homo sapiens
tcagcagctccccttcggggacttcttgacgccgggcaggagcctcgcggaagccgacgcgcgcttctggtgtcgccatttggcccggcggttcttgaaccagacctggggatggggggaatgctcagccctagccccaggtcctgcgtcccaccggctcccgagggtcccacagggaccgagaggggagcttcgcaacagggatgtgggcggacggcgctgtagagccgacacccgggccgcggctgcgcgccacctgcccttattcgctgcggacagactcggtgggtctggacgcgagatgggaacccccttagtacccgccccagcctccagctggcggcgaccaggacgccccttcttgggttgcgggctcttctgaatttcccaaattctggacgtgaacgcgggcctctttcgtcaccagaggaaagtgtaaaacaaaagaaaagaaaagtagccctccggttcctttcccgcggcacctccctgctctcacccgctcctcatacccccggacgcccagcgccgtccagggacctcctccctccggcgcgccagggcggggcttgggccgaggccgtctttgcaaagggcgcccgcccgccaggaccccagtccagtgtagccgcggcccgcgcgctccggggaaaggctgggcggggcactcacctccacgcgctcctcgcgaaggcggatgcggccggccaggcgctcgcgcgtactcacgtcaggatactggttctgcacgaaaagcgcctcgagcgcctgcagctgctcttcgctgaagatggtgcggtggcgcctcgtgcgccgctgcgaacccgggccgaccgcgcccgggagcgccccggaacctccggctggcgcacccagagacaagggcaccgccggtcccagcctcagcggccacgccagacgagcgcctgcggagcgagggcgcggtgaggcgcggggctggggccaagctcggcacccactgcgccgcgccccgggctccgccgggccccgcgccccgctccgcgcccactcacccagcccggcggccgcctctgggggcccgcagggcgccgcgcgggggccgcagcagcagcagcaggcgcagggcgcagcctcgggcgccccgggctcctctggcttcgcggggctctggcgaccggcgggctgcggtgggcaggcggcccgggccgggaggctccgctcgggcaggctggagaggatgtgctcgatggagaaggggcagggccgcccggcaccccggcggctcgccgcgcccccagccgctgccgccat

SEQ ID NO: 1053 - DNA, 100996 bp, Homo sapiens
ggtattcaatgcgtgttcatttattttacacttacaaaagaaatcgcccacccctttgccccattcccccaaaacagtctctttttacaaacatttaaaaattaaaaccaaatgaagatagacaagttaatttcagtacaattatttttcagtgtagctgtcataattagagtttaaatttcctacaagtgaccaatgtccaagtgacttatagggaaatcctgattatcggccaaaggaaattcaatattacaagttagcaaattctagtacaaaaatagtccgtgtgttggaacagctttccttttacataggtcttaggtcagtctgctgtaatacctaacgcttccggattctctctcacaaatggctcaatcgtcactgctgaagcagcatggtgcctgcagcagcaggggctagtgtccaccttggggccgtgctggagacggcaggcctgggactgccttgctggccccagggcacctgggcagagctccagccctagctccgcatcgggggcttggagggagggatgagcttccccctcctgaggcaatgtcagacccaggacacagggcacatctgcccagggagctgggctggcgctggtgcaggacagcacatctcctgccagtgtctcctccccctacagcctggtcaggtgagaggcggtcctgcatgtcatcagcggcgagagtgtggccctgcccttgctgcagccagggcaggctggggcaggctacttgtccctcaggatgtcgagctgttcctgacactcggtgaagaggcgctggaatcggaggttctgcccgatgactggtagcagctccttcagcagctccctcttccgcagaccctgtggacacagagtgacagctgagtgcaagtgtcagtgaagagacctagattgtggggactttcctggcctggcagagaaccttgtgtctgctcacgggagaaggaaagaacaattcctctgcaggtgagaaactgtgagagagctgtggggcaaatgtgcaggatgaagtggcaggtggaatgggagcaacacagtgtggggataaaggaggatgaggccaatgcagggtctgctcctccatccgtgggcacagccactgctgaccttatagtgactgagcagttccctgaccatccagggcaggatgagagtagaacaaggctgagggtcaggtggctggccattcaggaggggctgttccctcatgctgatgtttgccaggggtttgaggtcaagccccagggcaaggatgcacctggggggcagtgactggctttagttttccagcaacacaaatgaggtgccagtatcccctgatgtggaggatgttcggatgctgaccaaactatgcttagttgcctaaacatcctccacgtcaggtcatattggcaccacagtctgaaacaagcattgccagttggggtctctgctgcacagaccaaaagagcagactcctgagcagtacggctgctccaaagggaaaactaccagccagacaactttaacactggacgagaaggtctaagatcttgaattaacggtgacagatatacctgcaacaagtctagaagtgacagtaaagaataagtgtaactattaggtttgagtaacacagaagttgttagagatgggataagcaggagaatggctgctgttggcgaccaagtttgatggaggagcagcccacactccaacagggaggctctgacaccagagtgccatagtcagaacagagatggtatggatttgcaaaggctgaaatgtttactatctggtcctttacagaaaagtttgtcaactcctaaaatagatcatgttttctaactaaaataattgagtaaaactcataggtcaaaggggaattctaattaagtgaaattaaaaatgacttgcaagagaatggtaaaaaaaaaaaaccaacacaaaatactccaaaagtggtaagattcagcaaaagtgggcactttagaggcatttagaaacaacagcttatactgtattagagaacatgaaagaatgacaagccaagactccaacctaaagccatcaggggaaaggaaaaaaaaaaagactaaagaaaaaaaggacatgagaaaaaaacattttttttaaaaaaaggagataataaaaattgaaataaataaaatagaaaacaaagatttaatagagaagatttagaaaaacaattttattttatatatttttttgagacagggtctagctctgttgcccaggctggagcgtagtggtgcaatcacagctcgctgcagcctcaacctcccaggctcaagtgatcctcctgcctcagttacccgagtagctgggactataggtgtgtgccaccatgtctggctaatttttatatatttagtagagcggggtttcaccttgttggccaggctgatctcaaactcctgagctcaagtgatcttcctgccttgttctcccaaagtgctgggattaaaggcgtgagccactatgcctggcaaaagtcatttcttgaaaagactaatggacaaacgtctggcaggattaatcaagaaagagagagaaagcttaaagaaataatattagaaataaaaagagacataactacagatatagaagaaagaaaaagatatgattactatcaactttatgctaagaaatttgaacatttagagaaaatggagaaattcctagaaaaatataatttatcaaaactagctcaaaaagaaatagaaaggaaaagttaattattaccataaagaaaacatcaggaatactattttaaaactgacatcaaggatgagattttctttgtctttcctttcccacagtttgactaatgtgtctcagtgcaggttcctttgggattttcctacttagagttcactgaggctcttgtattagtagacccccgtctttcctcaaatttggaaaatttccgccagtatttcttcaaataagctctctactcctttctctctcttacacttctagaactcccattatggattcatgggtatacttggatggtgtctggtaagtctcttagactctgtttgcttttcttcattctattttctttttgctcctcatacttgataatttcaaatgacctgttttcaagtttgctgatttacccttttgtctattcgagtctgctgttgaacccttctagtgaacttttcaattcagttattgtatttttaaactccagatttctgtttagctctttttttggaatttctatctccttgttgatactctcattttctttttttttttcttgagatggagcctcgatctgtcgcccaggctggagtgcagtggtgtgatctcggctcactgcaagctccgcctcctgggttcacaccattctcctgcctcagcctcccgagtagctgggactacaggcgccggccagcacgcctggctaatttttttgtatttttagtagagatggggttccaccatgttagcaaggatggtctcgatctcctgaccttgtgatccgcccgccttggcctcccaaagtgctgggattacaggcatgagccactgcacccggccctcattttcttcatatatagttttcctgattttgtttagttgtctgtattctccttgagcattttttaagacatttattttaaagtcttatgtctgatgggcacagtggctcatgcctgtaatctcagcactttgggaggccaaggcgggcagatcgcttgaggccaggagttcgagaccagtctggccaacatggcgaaaccccatctccactaaaaatacaaaaattaggccaggcgcggtggctcacgcctataatcccagcactttgggaggctgaggcggctggatcacttgaggtcaggagttcgagaccagtctggccaacatggcgaaaccccatctccactaaaaatactaaaattagccagtcctgacctcaggtgatccacctgccttggcctcccaaagtgctgggattaaggcatgaaccaacgcacccggcagtccttttacttttaagccattgtgttattacatgtaagctgggtttcttataagcagcatacagctggttgttattaattctaatctgataatctatgccttttagacctatatttaatgattattgatatattagggtttaaatctaccatcctatgtatgtttttctgccttcttttgaatgaatgtattattttctatcattcaattttatctatttgttagttttttagctacgattctttttactgctttgggatttgtatgtgtatgtgcatgagttttattttttggttttggtggttgctctagggcatataacatacagtatatgcctttacttatcatagtctgtcttcaagtattatatcactttgcataatgtgtaaaaatcttttaatggtatactttcatatccccactcctggcgtctgtgatactgctgtcatgccacttcacttctacatatgttataattacaaactacattttcattatttggcttaaaaaggcagaactttttgactttttttttttttgagacagggtcttgcgctctgttgcccaggctggagtgcagtggcgtgatcttggctcactgcaacctctgcctctcaggttcaagcaattcttgtgtcttcgcctcctgagtagctgggactacaggcatgtgccaccacacccggctaatttttgtatttctagtagagatggggtttcgccacgttggccaggctggtcttgaactcctggcctcaagtgatctgtccacctcggcctcccaaagtgctgggattacaggcgtgagccaccgcgccgaacgagaacttttttacattttgacatttagatgaacacttttgacatttaattcttaaccctttggaggtatatttttatgaactgaagatctgcttttacttagttacatataaataaccagtttcctaaactccatttattgaatagccccccctatttttcccactgtatctgttttgtcttctctctcatatagcaaagtatctaaattactccggcttcataataaacccaaatatctggtagcatagtgaatgtcttaactattcttggctttttactgctccatataaattgttgaattagcttgtcaagtttcattgaaacctctagtgggcatttgattagagaggcattgagtcagtaggtctgtttagaaacggttggcgtcttttactgtactgcactttctcatcgtttgtccaggttttctttaatgactttaagtaaacgtttataattcttagcatataggctatgtacatcctttgttagatttattcttagatactttataattctcaaaagagacaatcttgaaagtggcaaaaaaaaagtgactcatgagagggatttgaagtttgtgaagaactacacgcacaattgctggcttaaagatggaggaggcaggtggaaagctaacaaggaaatgaattctgctattccaataacgactgagcttggaagaggaccttgaaccctaggtgatctcatctggccagtaatttgagtagagaattcaggaaccactgcaaaagcacaccaggaagaccgaaagaaatcacagatcctttgaaagaagtggcaggctgctgcaaattccacaagacaggtgaaaaactctggtgctctctcaaaagtgccatctcctggctggaggccaattaactcaggacattacagcaattcataacagaacaaccctgctccaaggaaggagaaaaacaacagctaattccactgcctgcaacatcctttctaaccagtggtcctgagtgtgtccacatgatgacttcactggtagcataaccagcatttgagaaagcctgcacactaaacatatctacaaacaaggactctcacagagtctacgccattcccctggcaccaccaccacagcaggtgctggtatccacagctgggagatctgaagatggatcacatcaccgggttctttgcagacgttccccagcatgggcccagagcctggtagccccactgggtggctagacccagaagggcaataataatcaccgcagtctggctcataggaatctccatccctaggggaaggggaagtgcaccaaatcaagggatcaccctgtgggacaaaataatctcaacagcagcctctgagttccagatttttccactgaactagtctacccaaatgagaagtaatcagaaaagtaattctggcaataatgacaaaacaaggttctataatacctccaaaagaccacactagctcctcagcaatggatccaaaccaagaataattacaaagtacattttcattatttggcttaaaaaggcagaactttttggctttttctttttcttttttttttgagacagggtctcgctctgttgtccaggctggagtgcagtggcgtgatctctgaattgccaaagaattcagaaggctgattattaagctactcaaggagataccaaaggtgaaaatcaacttcaagaaattttaaaaaatatataggatatggatgaaaaatgctccagagaaatcggtatcataaagaaaaaatcaaaaaatcaaaaatcaaaacttctggaaataaaagacacacttagagaaatacaaaatgcactagaaagtttcaacaatagaatcaaagaagtagaagagagaacttcagaattcaaagacaagactttgaatcagacaaaaacaaagaaaaaataattttttaaaaaaatgaacaaagcctccaagaaatttgggattatgttaaatggccaaacctaagagtaagaataaatggtgttcctaagaagagaaatctaaaagtctgaaaaacgtatttgtggggatagttgaggaaagcttccctgaccttgctagagatctagacatccaaatacaagaagctcaaagaacacctgggaaatttatcacaaaaagatcatcacccaggtacacagtcatcaggttatctaaagtcaagacaaaggaaagaatcttaagagctgtaaggcaaaagcatcaggtaacctatacacgaaagcctatcggatttttttttttgagacagagtcttgctttgtcatccaggctggagtgcagtggtgcaatcttggctcactgcaatctctgccgccctggttcacgcaattctcctgcctcagcctcccaagtagctgggactacaggcccctgccaccaggcctggataatttttgtatttttattagaggtggggtttcaccgtgttggccaggctggtcttgaactcctgaccttaaatgatccacccaccttggcctccctaagtgttgggattacacgaatgagccactgcgcctggccagaatacctatcagattaacagcagatttctcagcagataccctacaagccagaagggtttgggttcctatttttagcttcctcaaacaaactaactgccagccaagaatttagtatccagcaaaattaagtgtcatatatgaaggaggcataaagtctttttcagacaaatgctgagagaatttgccaccaccaagccagcactacaagaaatgctaaaaggagttctaaatcttgaaacaaaaccttgaaatacaccaaaatagaacttccttaaagcataaaactcacagggtctataaaacaataacaaaatgaaaaaaaaaaaaccaacaaaaaaagaaggtattcaggtaaaaacaagcatggtaaataaaacagtacctcacatctcgatactaacattgaatgtaaatagtctaaatgctccacttaaaagatacagaatggcagaatggatacaaatccaccaaccaaatatctgctaacacatatggactcacataagttgagggtaaaggggtgaaaaaagatattccatgcaaatacaaaccaaaagcgagcagaaatagctattcttatatcagacaaaacagactttaaagcaacaatagttgaaaaagacaaaaagggacattacataatgataaaaggatcagtccaacaggaaaatatcacaatcctaaatatatatgcacctagcacgggagctcccaaatttataaaacaattagtactcaacgtaagaaatgagatacacagcaacacagtaacagcggggacttcaacactagacaggtcatcaagacagaaaagcaacaaagaaacaatggacttacactataccctagaacaaatggacttaacacatatttacagaacattctacccaacaactgcagaatatacattcttttcatcagcacatggaacattctccaagaaagaccatatgataggccacaaaacaactctcaataaacttaagaaaatcgaaattatatcaagtaccctcttagaccacagtaaaataaaattggaaattaactccaaaaggaaccctcaaaactatacaaatacatggaaattaaaaaatatgctcctgaatgatctttgggtaaacaatgaaatcaagatggaaattaaaaagttttatgaactgaataatgacacagcttatcaaaacctctgggacacagcaaaagtggtgctaagaggaaagttgatagcattaaatgcttacatcaaaaagtatgaaagaggccaagcacggtggctcgtgtctgtaatcccagcaattttggaggccaaggcaggaggatcacttgaggtcaggagttcaagaccagcctggccaaaatgccaaaaccccgtctctatcaaaaatagaaaaaaattagctgggtgtggtgacgcatgcctgtagtcccagctacttgggaggctgaggcctgagaattgcttgaacctgggaggcagaggttgtagtgagccgagatgcaccactgcactccagcctgggcgacagagcgagactccgtctcaaaaaaaaaaaaaaaagatccaattaagctaaattagaaacaaaatgaaagatattacaactgataccacagaaatagaaaagatcattcaagactactatgaacacctttatgcacacaaactagaaaatctagaggaaatggataaattcctggaaatatataaccctcctagattcattcaggaaaaaatagaaactttgaacagaccaataataagtagcaagactgaaacagtaatttaaaaattgccaacaaaaaaacagtctgggaccagatggattcacagctgaattctattgaacattcaaagaagaatttgtaccaatcttactgaagctattacaaaagacagagaaagagggaatctccctaaatcactctatgaagccagtatcaccctaataccaaaaccaggaaaggacataacaaaaaatgaaatctacagaccaatatccctggtgaacatagatgcaaaaatcctcaacaaaatactacctaatcgaatcaaatggtgtatcaaaaagataatacaccatgatcaagtgggtttcataccagggatacagggaagacttaacgtacacatgtcaataaatgagatacatcacataaacagaattaaaaacaaaatcatatgatcatctcaatagatgccgaaaaagcatctgacaaaatctagcatgccttcgattaaagccctcaggaaaaccgtcatagaatggaaatacctcaaggtaataaaagccactatgacaaactcacagttgactttataccgaaaagggaaaagataaaagggttccccctgagaactctaacagacaaggatgcccactgtcaccactgctattcaacattgtactggaagtcctagccagagcaaacagacaagagaaagaaataaagggcatccaaatatgtaaaggggaagtcaaaatatcgctgtttgccaatgatatgatcgtatacctagaaaaccctaaagactcatccaaaaagctcctagatctaataaatgaattccgtaaactttcagggtacaaaatcaatgtacacaaatcagtaacactgctgtataccaacaatgaccaagctgagaatcaaatcaagaacctcttgttacaatagctgcaaataaaataaaataaaatacttcggaatatacctaaccaaggatgtgaaagatctctacaagaaaaactgaaaaactgattgctgaaagaaatcatagacaacacaaataaatggaaacacatctaaagctcatggtaggtaaaattaaaaatgaccatactgctaagagcaatctacagattcaatgcaattcccatcaaactaccatgattattcttcacagaactagaaaaaacaaccctaaaattcacaagaaaccacagcagggtgtggtggctcacgcctgtaattccagcactttgggaggctaaggtaggcagatcacttgagcccaggagttcgaaaccagtctgggcaacatggcgaaactctgtctctacaaaatatacaaaaatcagctgggtgtggtggctcacgtctgtaatcccagcactttgggaggctaaaatgggcagatcacttgagcccaggagttcgagaccagcctagacaacatggtgaaaccctatctttacaaaacatacaaaaattagccgggtgtgctggcacatgctgtagtcccagctactcaggaggctgaggtgcaggatcacttgagccttggaggcagagtttgccatgagccgagattgtgccactgcactccaacctgggtgacagagtgggaccctgtttcaaaaaaaaaaaaaaaaaaaaaaaatcatatggaacaaaagagcccaaatagccaaagcaagataaagctggaggcatcacattacccgacatcaaactatactacaaggatatagttaccaccaaaacagcatggtactggtataaaaataggcaaacagaccaatggaacagaatagagaacccagaaataaagccaaatacttacagccaacagatcttcaacaaagcaaacaaaaatacagagtggggaacaaacaccctattcaacaagtggtgctgggataactggcaagccacatatagaagaatgaagctggatcctcatctctcatcttatacaaatatcaattcaagatggatcaaagacttaaatctacgatctgaaaccacaacaattctagaagataacatcggaaaaactcttctagacattggcttaggcaaatagttcatgactacgaacccaaaagcaaatgcaacaaaaacaaggataaagagatggcacctaattaaacttaaaagcttctgcacagcaaaagaaataatcagcagagtaaacagacaacccacagagtgggagaaaatatttgcaaactatgcatctgacaaaggactaatatctggaatctacaaggaactcaaacaaatcagcaagataaaaacaaataaccccattaaaaagtggacaaagaacatgaatagacaattctcaaaagaagatatacaaatgaccaacaaacatatgaaaaaaatgctcaacatcactaattatcagggaaatgcaaatcaaaaccacaatgacataccaccttactcctgcaagaatggccataattaaaaaataaaaaaaatagatattagcatggaggtggtgaaaagggaacacttttacactgctggtgggaatgtaaactagtacaaccaccgtggaaaacagtatggggactcgttctggagatggagtctcactctgtcacccaggctggaatgcagtggcacgatctcggctcactggaacctctgcctcctgggttcaagtgattctcctgcctcagcctcctgagtagctgggactataggcatgcgccaccatggttggctaattttttgtatttttagtagagacagggtttcaccatgttggctgtgctggtcttgaactcctgacctcaggtgatctttccgcctcagcctcccaaagtgctgggattacaggcatgagccactgcacctggccagagattccttaaagaactaaaagtagaactaccatttgatccagcaatcccactactgtgtatctacccagaggaaaagaagtcattatgtgaacaatacacttgtacacacgtttatagcagcaccatttgcaactgcaaaaatacggaaccagtctaaatgcccatcaaccaatgagtggataaagaaaatgtggtatatatacaccatggaatactactcagccttaaaaaggaatgaaataatggcattcacagcaacctggatggagttggagaccattattctaagtgaagtaactcaggaatggaaaaccaaacattatatgttctcacttataagtaggagctaacctatgaggatgcaaaggtataacaatgatgtaatggactttggggactcagggggaagggtgaagagggtgagtgataaaagactacacattgggtacagtgtacactgctcaggtgatgggtgcactaaaatgtcaaaaaaagaaaaaaagcaactcatgtaaataggatattcaataagattatcagcatagtcagtgggatgacatattcaaaagaaagaaagaggccaggtgcagtggctcacacctgtaatcccagcactttgggaggctgaggtaggtggattgcttgagctcaggagtttgggaccagcctgggcaacacagcaaaatcccacctctaccaagaaaaaaaataaaaataaaaaatttgccaggcatggtggcgcacatctgtggtcccagctactcaggaggctgaggtgggaggcccacttgagcctgggaggtggaggttgaagtaagtcgagattacaccaatgtactccagcctgggtggcagagtcagactctgtctccaaaaatctacaacatcgtggaagttggaaaacacactgttattttaaatttcatgtatttttataaaaacagatggagttggttgggtgtggtggcttacacctgtaatcccaacactttgggagcctgagacgggtggattgattgagcctaggaatttgagaccagcctgggcaacatggagaaaaccccatctctacaaaagatacaacaattagttgggtgtggtggtgcacgcctgtaatcccagctactcgggaggcagaggcaggaggattgattgagccagaaggttgaggccacagtgaggggaaaaaaaaaaaagagagagagagagagagtcttgctatgttgctcaggctggtctcgaattcctgacctcaagtgatcttcccacctcagcttcccaaagtgctgggattacaggtgtgagccaccacgcctggctgaaaaaacacactattaaacaaagtgagacaaatgaaaatgaaaatacaacataccaaaacttacagtatgcagtgaaagctgatctcaaatcaataatctaacattacaccttaaggaactagaaaaagaactatacctaaagctagcagaagaaaataataaagataatgggacaagataaatggaaaataatagagataatcaatgaaaccaaaagttgattctttgaaaagatgaacaaaattgacaaacttttagctagactacataataaaaagagagacaagatccaaataatgaaaatcaaaaatgaaagcagggacattacaaccaatgccacaaaaataaaaaagattataaataagagaacagcatgaacaactatatgacaataaatctgataacctacataaaatggaaacaacttaccaagactggctcataaagaaattaaaaatctggacggatctctaatgagcaagaaaactgaatcaataaaacaaaccctctcataaagaaaagcctaggatcatatagcttctctgatgtattctaccaaacacttagagaattaacaccaatcctccttccaaaataggtaggaacacttcctatttcattctatgaggacagcattaccctgacaaagctagacaaagatactacaagaaaactattagatcaatatcctttgtaaacagtgacccaaaaatcctcaacaaaatgccagcaaacagaattccaaagtacattaaaagaattatacaccatgaccaagtgggatttattccttgaatgcaagaatggtttaacatatgaaaaccaatcactgtaatacatcacattaatgaaataaaagaaaattttaaaatgacacgatcatcttaatgcagaaaaagcatctgagaaaatgcaacattctttcttgataaaagcactcaacaaactaggaatggaagaaaactatctcgacatagtaaagaccataaataaaaagcccacagctaacatcgtacttaatggtaaaagactaaaagcttttcctttaatatcaggaacaagagaaggatgcctgcttccagcactaatatttaacgtagtattaagagtcctagacagatcaattaggcaaggagaagaaataaaaggcaaccaaattgggaaaaaagaagtaaaattatttctgttcacagatgacatgatcttatatatggaaaaccctaaagattcagcgaaaaactactataaacaaagcaaaacattctgcctgcctgtggtactaggaagaagctgcaagaggacttgccctctggcctgaaggcaatgtaaagagcagccaagtattattgatatttcctcacccttcggctctcagtaaaggatggtttttccactctttcaggatgcgatgtatagctctttgtacagcctgcaacacacaacttaatcaccacctctctggccactgccacaggtcttacagcagcagtccccaaccttttcggcacccaggactggtttttttttatggaccagtgggggaggggaagacggtttcaggataaaactgttccacctcagatcatcaggcattagattctcataaggagcacacaacctagatctctcatatgtgaagttcacaatagggtttgtgctcctatgagaatttaatgttgctgctgactggtctgtggcccagaggttggggacccctgtcttacactgaagaccacagcaaagggaggcttcctaagaacagggcctggctggggaggctggagccagaacaaagcccaggaacctgaaaggtgtttgcttagtgccccaaccttctgcttctcattttcctcccatgcacactgaaccatgcaaaggatccttgaagttgaaagaaatctgaacctttggtgtccctgtggtgcactggcagctcaaatcagagtatataaagagctcctataatatacatagagttcctacaaaccattgagaaaaacaaatggcaacaagtatttcaatagatagttcaaaaaagggaaacacaagcggctcttaagcatgtgaaatgatgctctcctaacaagccttcttgggagggctgctgagtcagcatggctggttggaagtccaccctccaaccacagctatattttcccagttatttgaaggatcagttccacttgaatgaccaattctcaccataaatgttgataaataaggccaggcacggtggctcacgcctgtaatcccagcactttgggaggctgaggtgggccactgcattccacactccagcctgggtgacagagagagacttcgtctcaaataaacacataaataaaataaaagagtgttgataaataaacccaagaagagcacagaaggctcatgctcactcatctcctctgccccaacatctagatgaaaagacagtaaacatacagaaaaaaaggaacaaattcagaatagtgttgagatcaggagaggacctggcagaagacactgggattggctatgtctacgtctgctctaaatcctcttctcttacatattctttgtacagagggagaaaacctgctcattttcccagcctcccttgcagcagaggtgggtgcccaagtgatttaatggttgcctgtgaggcacagactagtttctgggagagcgtttcttttctgatgagagggtgaatgttgctgttgccagatttctcctgttctctctccttccctgatcttggacatggaagccaccttgtaaccatgagggaagggctaggagacctttacagagggtggtaagcgggtggtacatactgacaggtgactctgggaggggaaccacagattctcttaggcagagcctcagtgaagtgtcctgtttggagttggtaagaataatcagcaggaaggaggggagaagaagaaatcatggccatcaaatggtagcctgtttgtggctccttctgtctataccaccacggcccagagtgcttactttcaggctgagaaagagaactactatggtgagctttggcgggcatcttgggctaaggctgacagaatgaagctccacaacctgcccatgagggggactcactgggcaggtttctgcctgcctcccactctagtagatggctcatcggcctgtcctggaggtgagatgtgctaagctgtgctaagcgaacagctgtactcttgaaaaggaaacctgaggccactatcaatctgggttcttcacttgtaactacaacctgataaccaaggatttccacatagggtaaaatgtcctcaagtaaagaccgcaatgaacaaatcaaagattgaacccagaaaagccagataattcagggaacaaattattttagaaaatgttagcatctgcagctgatatctgagaagatatcacaagcctttccttccattaatagaccatgcaattcagaacagccttcctcactgacaacaaagaaaaaaaggtggacaaatagcagcaaacttctgagagctaatgtgttaatgataaatgactgagccatgctgtggggaagacagagatccaaagagggatgcctttgctttggaaatatttatccatgaggaagaagctaggcagaacttctaccaaacttgagggcctgggttgggagcggtggctcatgtctataatcccagcacttcgggaggctgaggtgggtagatcacctgaggtcaggagtttgagaccagcctggtcaacatggtgaaaccccgcctctactaaaaaaataaaaattagctgggtgtagtggtgtgtgcctgtaattccagctacttgggaggctgaggcaggagaattgcttgaacccaggaggcagaggttacagtgagctgatattgtgccactgtactccagcccgggtgacagagcgagactccgtctcaaaataaacaaacaaaacaaacaaacaacttgagggcctagggggaccatagcaggggctagggccctgttaacttacccctcctttgtcctggtattccaaaggtacgcaacctagaataagcgtcaactggaagtaaactagcctctataccagctggcacccagctttgagttccaggcagcctagaaaacctcagtccctgaacgggatcatggagtccctacagtgctactcccaagaagttggcagaagcaaatagaagtgttctgtagaagaagataacatcatcttaggcctcaaactatttctacaataaatttttcaaatactatgtccaccagatagtaaaaaataaccaggtacataaggagataagacaatctgaatgagaaacagcagaaatatttataggcaacggaaatagatctgcaaaggctcctgatactagaattatcagacataaaactttaaaataactaagattattatgctaaagtagataaaagcctaaattaaaaatctggtgaagaattgaaagcatgaaaaatgatacagctgatttttttttttttgagacagagtctcaccctgtcgcctgggctggtgtgcaatggcgcgatctcggctcactgcaacctccgcctcctgggttcaagtgattctcctgcctcagcctcccaagtagctgggattacaggtgcccgccaccatgcctggctaattttttgtatttttagtagagatggggtttcactaagttggccaggctggtctcaaactcctgacctcatgatccgacccccttggcctcccaaagtgctggaattacaggagtgagccaccacgcttggcctttttattttttattttttgagatggagtttcgctcttgtcgcccaggctggagtacaatggcgtgatcttggctctgcctcctaggttcaagcgattctcctgcctcagcctcccgagtagctgggattacaggcacatgtcaccaagcccagctaatttttttttttagtagagtcggggtttcaccatgttggctgggttggtctcaaactcctgacctcaggtgatccgcccatcttggcctcccaaaaggctgggattataggcatgagccaccacgcctggcctgatacttgattttacttttttttaaattttccttttcttgagacggagttttgctctgtctcccaggatggagtgcagtggtgtgatcttggctcactgcagcctcctcctcccggttcaagcgattctcctgcctcagcctccccagtagctgggattacaggagtgtgccaccacacccagctaatttttatttttagtagagacgggatttcagcatgttggccgggcaggtcttgaactcctgacctcaggtgatccacccatctcggtttcccaaagtgctgggattacaggcatgagccactgtgcccggcgatacagctgattttaaaaagagaggatattacatctctcagatgatggggaaaatgaaagggaagaaataatcaaataggaaaaccgaagaaaatcactggtctctgtctctgtttctacagaatgaatgagctttctgaatcttcaaaacaccaagataggatcccaaagtacttacaaagcaatggaaattagatttacaatagatttttttagcaataacactggatgcaaagtctatggaacaatgccttcagggacttaaggggatttgactttgaacccaggattcaaagtacctagtcaattaaggtacaccacagtcaaatttaagaatggaataaaaaattaggcctctgtacacaccaaggcctgtgagggctgaccctctggccttttgatgtcaactcctttcacccttctgctaccatcccgttgggctgttccttttaaactccaagctctcccacctcaggcctttgcactttccctctgcctggatgttcttctcccaaatatatgcatggtttcatccctcaccttttctggtctctgcttatctgtttgtttggcctttcctttttcttttctttttttttttttgagacggagtctcgctctattgcccagactggagtgcagtggcgcgatcttggctcactgaaagcttagcctggcctttcttaattgcccagcatgaaatagcagcctgccagtattctatatctccctgcccttttaatttttttcccatggcatccatcaccactcaagacactacagatacctcttctcatttgcttagtctgtctctctccataagaaagcagatccatgaatgcagggactcagtctgccttattcactgctgcctgccccattcactgctgcctgccctatgcctataacatgcctggccaggggaggtgccccatcagtaattgctcaatgattgaatgaagctgtgagctaactcttagatccataccttctcccatcccccaccaacctgttaccttcttgatttaatgaatggttctggcatccattttttgcagctgaacctggaggtgccacatgttcattatgctttttccttccacatccaaccacccatcaaatcttattggttctgcctccaaaatacatcttgaatctgtctcctttcccctctccatggccaccacactgatccaagtcaccttcatctcttcctgggactgttacagaagatactccctgactgtttttctattttagttcatgacacctctgtgccaactctgccaagaagaaaacgctagctcctgtaaaggtctctgtggtccacctcctgcctcatttcacaccaccctctccttttgccttctatgtgccagccacagtggctccaaacagatcaagcactccttgcttttactctcacttctactaggaaacactttctccaggtctctgtatggctgtctcactcttctccttgggtttcatccgcagtgtcctctcacaaggccttcctggtcactccttcccaggcactctcatctgaagaccctgcttacttccttcttagtctgaatctagtctgaaaatattttgttgacctaactgcctccctgtttatgtgtgcatccctaccagaccgagctccacgaaggcagggaagtaccttccgtcttttgtcttcacaaccaagcccagagcccctgcaggcagcctccctcagcacaggcacgtggcggagcactccgtggctcctgatgtccagggcccagctcctgccaggttgtggagggccgtcggcatgtcaccctctcactgatgctgggacctgaggctgggtgctggagaagtctaacgggacacaatttcaaagcactttggcttatttaaaaaatctccaccttcatgtttcaagaaagaattcttgcagcaacaatgaaagaagcacctaccactactgttgactcccactggcttccagtggagtagtgaaccggacccagtaagtccttgcatatttctcgaagtcggtattcaaaccctaattacagaaaaacaaacaaacaacaacaacaaaaaacaaaacagaaataggaacacattacaaaaagaaataaaatcaagaatatgttgttgtgtctatcaaatcagaataaacacatgcgtattttattgcctactatgggcaagacgcccctgcatgtctctcagcggggggcactgagacccataatcacagattttcactcacttgctcactcccctgacatctgtagtgcctcctctgtgtgttgggcccagaggaaaaacgagatatggccagttctgtgataaactccttaaggtgatgggaagatatgggaaattgtgggctggtgagatctgtctttgagaagatgcgctggcagctggtgttgaggggaggtcaggagggtgggacggccagcccgcaggaggtaagagatggcaaaggcatgactgaagaggggcaactgagtggagggggcataggtccattaactcaagggttatgggcaccacccagtagggctgctagaaaggctggaggtagagtgtcggggtttgtcagcacttggggcagctaaagcaatagggaatggattaaactgtccaaagaaaagggtggagtaagagagatgaaactggaatctgaggaattttggaagtgaatggggtccacttttatactagattcctccttttacagccaaggaaacaagggacagaatggagggtgggtaactggtgtatggacactagaacaggcaggtggaagatggagaaagagaagcaagcagcagaagtcatcccaagatgggtggcggggcggagaggaggtggggacttgatgcagggcatcagagcaagtcccagtcaacacccaggatgaagcaaaccagagtggagtaagaggaggggctcccagggaagacgtgactagagcaccacaggagaggtatgagagcctgggaaggctgagtattcagaaaagctggggaccacacataatggcaaccacatagacctggtgggaagagtaaacatcaaattcatcatcgtggtctgcagggagggaggggaggcttcaagttgatcagtaatatttgctgtcgtttacaagtgtatgtacacacacacacacatacactcgtatttacacagccagaggcacatgtgacatgttagttctgggaattacatccgtgaaggtctgattatgattttctctgtcttttctgtacttaaatttttttctaaattataatcaaaatggggagggtgatgacaaaaataaagcaaaaagcccaggaagctgcacagagagagctctgggagggcctgccccatgccgcaccctgaaggctgcactcaagtgggaggaaaagttggtaaggctattggagtcactgtgaggacagtgcagccacctcttccagcacacctggctttctgcaagggaggcagcagagtgagagctctggcgggaagtgccagaaatggagggcctcagtaagtgcaggacatcaggcaagcctgtccagggcaggaagggctgggaggaggaagagaaccactgctacaagatgccctcactgattagcagcactgccaagttgtggtgcagggcaggagccagaacatagaatctgctccttcagaccatgtctttccacccaggcatctattcctccgtcctgctgcctgtcctgctgcttctctgcgggaacaccctcagggtcactctattcagagcctcagagcctataaggggctgggtgcctgctgagctgccttgactgcagctcaggctgggaggtagaggctgctgggccatcacatcttttccctgatttcacagggactaagtgaggcctgggaggatggaggggcagaaggagaaggctgctcagggctgccaggagcctcaccttcgtttacgaggtaccgtgcgtagacgaggagccaatggcggtactcgtggctggactgcagggtgagtgctgctgccacctggttctctaggtaggccagggtggtctcttgctgcaccacatgaggcacggagaagagccgggcagcctgccttcccgagctgcagagaccaggagagtttccatgatggggcagcaggcactacacagagtcaggaactgcccccgtgtgcaacaggcaaggagctggcaggaggcaggcaccagggctgccaaggcctcccgtccactagccagtctgttggcagatgccagatctgttgtctgcccatccccacgccccagccatgtgcctcctggcacccttggggtatctcacccagcacctgccatctgggcccctgaagtgacagggccagtgattgctgcccccaaccccaagatattacctgatgcaggaccactaccctcagcacccctagtccgtcctgcccagcctgcctgtgctgaccagcacctggggcacaggggaagggcaggtggagaccaggcctgggcagggactgtgcgtgcactgacccaggcacttccccagggcaggactaaggacagtggccatggcattcaggtcacgtacttggaggtgcggccctggattatggctaacggtcctgagcacagcatggcgtcctgggatggcaggctgctcctaaagtctgcacactgagccagtgagtcctgcttgtcagaaaccaggttcctggggaggcaaaggcaggagcagagctcaggaaaaccaagagatctggttggcctctttgccaaccagagaaggctggcaaagaggccacagagaagcagcccctgccgacacagaaagccagtagaggctgagcgcccctgcacttccgcacaggcgcctatcactgacaggtttcatggtaatgggtctgatagatcactgttccaaaggaaaaatgagtgaagtgaaggctgtggatagggcccttgctgggaacacttcagctccatatgttggttcctgatgactgcaggcctctgtgtgcagtgtgctctgatgctcagctcaaacactgccatggtctgcccacagggccacatggcctgggccctgtagctagcgagcaatgccaggcctctacctgcctgtatttctacaactatcccagactggcagtccttccaccttctctggacccttctcatccttgtgaagaagactcttcacacacttttagaacagctagatgtctttgtaaatgtgtccaaaatacaaagatgcctacagagagtcaatatttctcttcttaaataatcagcttatttccattattacagcaatcatatataatagacaacattttgcaatttgggggagcaggcagtggagattttttttttcctttgagacagggtcttactctgctgcccaggctgaagtgcagtagtgtgattacagctcactgcagcctcgacctcctgggctcaagggatctcctgcttcagcttcccaaggagctgggactacagatgtgtgccactgcacctggcttatttaaaattttttttttttggtagagacagggtctcactatgttgcccaagctggtctcaaactcatgggatcaagcaatcctctcagcctcccacagcgctgggattacaggtgtgagccatcgcacccagcagattttttttttccaaattcaagaaagaagtctcagtgtgaatgtagacttctgcatggcagttcttaacagaaaaggggctaggaggtagcaagctttggttcttaaggaccaaaggtatagacagaagaaaagaacttggagtggctggaacacaacgtacataattcacgtgtctgggttaagagctctgatgtataaattattttgcaagtacaaaaaagggctccaaattcctgagtggacagaggaaaagtacagaccatcatgcctgggtaagtggataagcatccttactaattcactgaggaagtctgaagtgcttactaagctcacagaaattgactagtcctgttaaggctcctgtaaagcccactaacctatgctcatggtggctaagggggccacagcaaaaaccataaaaattttggggctttttcaaaaagtgcctcctgaaaataatgcaggaggacagtgctcctgcacacaggctctgagggcagaggccataggctgcagtgtcctgctgggacaggggagcatgcacagatagtcaatgcagcctgcactccagggcctgactctcaggaaaagcagggctaggcagccctgtaggccacgaccctttgctctgctgtctagagcagacagacactcttccagggaataggactgggggtcagcttgcttaccatgtggaaagtgacggattaaagcagtacgccttcccatcggacaggttcattactgggattccatgctgcgtcagcaagatctgtgataccgtcatatcacttcctgaggacagcatgggaatgagttctgggtgtgctctgatcagcaagtgttttcaaacatatcaaaggagaaatctgtactctaggctcccacagtcccagcagcaaatgcatcaacactgccttggcaaatagggagggcaagccattctccttgccacacaccaggcttttgtcacctcttggggacccattcaaacatgcccccaaaaagtgtgtgtctcctgcagcgtaaccacacctcctgcctcactgagagccctgggctgaggccagagcctggctctctgagcggggcccttctgcagcatcagacatgaacttgggcccccaaaagagtagggacagcctgttgcctgcattacctgccaggatggagtgtagagactcttctttcaccacaaccacctgtctgtgaacatccctaggagggagacagggaacagtttactcaccaacccaggtaaacacatcagagtgtgccttggctgctcagacaccctggccctactgcatgcgaccctaaccctggcctctcctagtgagaggggctctgggctacgagtggcttctgctctccatgtgccactacactccctctgcattaaggctgcagcacaaagcccaggcaacagagccatggggaaccctcagcgcccacaccactttgggggaagccaggccacagcagccacatcaggaacatggccacattctgccagctaagactccatttctgatgaatcttgcataggaccctggcagtgcaactggtcgcatgggctgctccagtaaggaaataatcgagcaggcaagctgcctccatcccccttgcacactacccctcagccctcagcctacccagggcacccaacacaagcaatatcactaactgctcagggcctcttctggggcctgatggccagccttgtccactgccttccctgcccctgcagtgaggtggggcctacacagccctgtcctgccctggctgaagcccaccccaccctgtgcctgcctctcaccagacagagagtgtggctgcagcggtgagcgccatgacgtaggagcctgtgcaatgcaaagtagagatcggggatggcaggaggatgggagagaggagacggcgaccacaggtggagaacactgacagcatccttttttcacaggcgacacacaccacgtcactgagaaggcagagtgggggcaggtgtcatgggggctgagtgctgcagccaagacagtagccctggaagtgtgggccttccctctgcctgggcccaacaagggcctcccctgagcaggtacagccagaagggaaggtggattgggtcagggtagggctggtggggctgttggagcctccctgagatcttggatgaaagaggcttctgtcctatttccacaggctgcctgcgctttcctgagctcatgctgatgctgaccaaggggtgtgggggctttggagagccaatgcctctgatgatcacccaggaaacatgccttgctcatcagataaggccacatagtacccacaggacagtctcctggctgcaactagtcagaccagtcctgagaaggtctctaacaaggcaggctaagagaagtatggggatgacagcatgcacctctgtgtccagggggctgtctggctggcgtgggagatgtgtgtcgctcccaaacaaggagtgcgttacagaacagtctggacactgtccagcttctcccgagtgaccaccaggcccctgggtgggccctgcacgagcaggctgctgccttcccagacagagccccctaaggcacagccacaggcccagggtgaggctggagctcagacgcaggcaggggtagcagatgtacagccagtacagtgagatcctggccacagtaggccacccagagccctgctttgtgtcacttctatcctggtgagccagtcactccagcaggctcaaggaggtcagttaaggaaggagctctgccaactgccttcctaatgagccactattgctactggctccaaaaagggagaggcaagtgagatgcttttgtttacaaatgtttacttggagagtatgaatcagagaacactctaagcagcacgggcaacaaggagctctctgcagtgctgtgactgaattcttattttttctgagacagagtctcggtctgtcgcccaggctggagtgtagtggcgtgatctcggctcactgcaacctccgcctccccagttcaagcgattctcctaccttagcctcccgagtagctgggattacaggcacatgctaccacgcctggctaatttttgtatttttggtagagatggggtttcaatatgttggccaggctggtactgtgactgaattctatctgcccatctctggtggtcagagcctggctcaagccagcccactgcaaagaaagccatcatttttgggctgtaacactggggaacaggtctgcaggctgggcctgaactgggcaggactaagcaggaggagaggtcccacgtggtccagcaggcttgccccacagctgccatgtcactgtgggagaggctgtgccgacaccccttagccctcagctgggcaagccacctgccttgaggggagggacagagagtgggagcctgtggaagcatctgatacacaggtgcctgggactgggaatttaaatggctcatctggagggggaatttgagggaggaacagaacaaacagtggggtcccctaggcctaaaaacacaaaactcactcagggcccacgagaattgtggtctaagacctaaggccatgtgctttgacacaagtaaaagcatttacatgggacctcatggcagatgattaagggtgtaattatgatgactgtatctggtcctgactgggatgctacatcagacaggaacctgaggagaaacattggttccccttccacattgaacacaggtagggacagggctcacgtacagttctaggaacccaggggaagatactgggtgactaatcactgaatcaaggtccccctcacagtgcagaatctggcatgggctgggatggggacttcagggacagtcagaaatccatcctgaccaacttggatggaaatctgggatccaaaaaaggaaccagcccaggtcaaggtgagccaggcacacctcagtgtggaattcgagactttggggatctggctggacaagggaatcaggccatcaggttcaaagcttggcctgggtaaccctcaagggctcagtttccccatctgtaacacggggatactgatgctgaccttgctgggtgctgcagggactgagatgacaagcacatatgcttggcctggagtgaagcctggtgtgagtctctgtgggagctggtgctcccagggtcatgcacctcccctagacaggcccaggcccagaatgatggcatgtgtgcctgtgtcacctgggccggctaaggacctgcccacccttaccagctgcccgcagcagtgaggatccggctggtgagtaccgtctcccactccttcccttcccggttgcacttcaggcggctcagcttcacgccccccaccactgtcacttcattctccacctcaatgtacatggaaggatcggagctgacctggatgaagtaaacacacgggtctgctcagacaagggccgcagcccaggtgacatgctccaaggctctgtagcctggggccccaaggcagcagcaggatacagaggcagactggctggccaagagaggagagggagggcaggtagggcaaaggggctgagcgggaggcccagagggccagacatgtggcccccaaggcagggagaatgctgggagctggtttctaccctgtcatttgtgtagttgaacagccagagaagagaagcagtgccagggttaaagaccccaaagtctcccaaccctgccacttcatctcacaagggagtaacgtgcccaaaagcacactgcaaaggaccgagctgggagtgagacttgggtttctagcctcctacttgaagaatcttcaaagatggcagtgtttggcaagattagagaccatgtcagtgcttggagggaatgtttagaaaacccccaaaggggctctccagttcctgtggtggtgagacttggtctgctcaactgagactaaactggcaggggtgtttatggcacagcatgtatgaaaagcacctaattcagtgtctggcaccaaatgggctcagccacacgcgtgtgtggggagctgaccaacagattttccctgtggtaaaataggcagaaccaccaaacagtctgtgcttgtgtggccactcaagtgggtgagctgggccgagggctgactgcccccttcacagacccagaaatgacagtcccaagcagtgcttggagggcaagatgcctaggggaagggctggaggagtttgggagagttctgtgctgagaagcagggcacccaggagggaacctaagtcagaacacctctgagtgcaagagcacgtctgaacgctgctgaccactggagggcccctgcctccgttcacaccagcaataagaacaaaccctatgggttcctaccctttggcttccctgcttcattcctctgcactgtggcccagaaggacctatggtaggaagggctgacgcctgctctctggtgccctgtgaggaccaacctgggctcagagcagtgtgtagccagtgggaagtgacccgcaagcagggtccaagaaggctgctcgaggacacgcacctgagctgaggtacaagggtatgcagagaggcagcagtgtgtgtgacggcaccatggcaggagaggcctagatactatgctgggccaagtgaccaggagggctctgggtataaaggattatttactccagaattgtgttttggataaccacatgcttacaagcttccattccaagagctcaaacaactctgatgattgactgtgccagacactgagaagacaaagctagcaggatggttgggagatagattatgaccacacattcccacagacaccaagcctgaggctgcccagggctgtgtgtggaggtggaggtggcttccagccaggacacctgagaggagtcctgaagagcaccagaacatgtggtggtaatggcagccccagcagctggaatcccaagggcaaagccagacagaggctatgggtgagtgagagtggaggctggcaatttcgctaagagttggtgggtaccccgatctgctatgacttctcccagaaggtgatggagagccactggaaaccaatctccaaggaagtgacaagataggatttgtatgcagtaggggacagagaatgtctgggtgtgcctgagggagaactggcagggtcctagaacttacctggagggtgaatgctctctgggggcttggaattggcagcttcagtgcaagtgctggtgcagacagacacatggcctccttctctgcggttagggcagctggagactggaagagccagaaacgttcctgagccttgctctaacactacggggtagcatttggtaaaggcaggtcacccagaagtgaggctgagcctgcgaccagagcatttccaccctgggagggaggaagcagaggggaatgctacaaggatcctaacctcatggacaagccagttgatgccagggaacctgctcaagggccctgggtgagtcaagggcacatctgagggagagcgtggcctccatgctacattccaggggctgcatgtctaagccagctggttcccaaggtgacccacccagctgaggcttaccatgcacacagggccttcaagctctaagtacagaaaggtgggctaaagaaggcaggatgggcccactggcctcacctggacagacagagacacaggcatgagacgagagtccttccgaggccgccctttcttcttcttctctactgtctctacctcaagctcaagttttcgcttggacagtgaggaagccttagccaaagggactttctcatcgctgtcactgctgctctccaggaggtctcggggcctcagctctttcacaaggttctgctcttttaacctgcacaaaaacattacatcacacttcccttcagaaaccattcatgcaagaaagagtgaagtgaaatatttaaagtgcttaaacaaacctcttgccaacctagaattctgtgtccagtgaaattatgcctcaaaagtaaaggagaaataatgactttgtcagacaaaaataaacaaagagacaccggaatctgttgccagaagacctgccttgcaagaaatgttaaaagtctttcagagagaagataaatgatgcaggccagaaactcacatctgcatgaagaaaggaagagtgatgttagagaaaaaaaacaatgaacataaaatagaatcttttgtatttcatattcccaactgatctgagagacaactttctgttcaaacaaataacagccaccatgtcttgaattactatagtttatgaatgagtgaaataagtggtaccaatgtcatagggcatggaaggaaagagtggggaactctttctactacccatgaagtggtataatattatttgaaagtagagttaggttataaatgtttattgtaaactctagagcaatcactaaaaaaaattttttaaagcataattaataatgctgagaggagagaaaatttatttttattttattatcattttttttttggagatggattttcactcttctcgcccagcctggaatgcaatggtgtgatcttggctcactgcaacatccacctactggggtcaagtgattctcctgcctcagtctcccaagtagctgggattacaggtgtgtgccaccacgcctggttaatttttgtattattagtagagacagggtttcatcatgttggccaggccagtcttgaactcctgacctcaggtgacctacccgcctcagcctcccaaagtgttgggattatggtcgtgagccaccatgcctggctgagaaaactgaatcatataaaatactcagctaaaaccagagaaggcagaaaaagaagataaaaagaagtgaagattaaaaaaaaagaataaggccgggcacggtggctcacgcctgtaatcccagcactttgggaggctgaggtgggtgaatcacctgaggtcaggagattgagaccgtcctggccaacacggtgaaaccctgtctctactaaaatacaaaaaattagccgggtgtggtggcgtgtgcctgtagtcccagctactcggcaggctgaggcagggcaattgcttgaacccaggaggcagaggttgcagggagtcaagatcgtgccactgcactccagcctggtgacaaagtgagattccgtctcaaaaaaaaaaacaaaaaaaacaaaaaaaagaaatgggtttatgtttttaaaaatttaattttaactacaaaagacaaagacagattaatagtaggtggacacagtggctcatgcctgtagtcccagctacttggtaggctgaggcaggaggactgctcgagcccagaggcttgagagcagcctgggcaaaataatgagaccccatctctaagaacaaaaaataagtaaataaataaatacaagaaaaggggtgattctaactatatgacaacctggaacaggcaaaaccatggagacaataaaaagatcagtggtttccaggggttggggaaaggaaggtaactatatgaagcacagaatttttaaggcattgaaactattctggctgggtgtggtggctctttcctgtaattcctacactttgggaggccaaggtgggcagatcacttgaggtcaggagtttgagactggcctggccaacatggtgagaccccatctctactaaaaatacaaaaattagccacgtgtggtggcatacacatgtaatcccagctacctgggaggctgaggtaggagaattgcttgaacctgggaggcggaggttgcagtgagccgagatgcgactgtgccaccgcactccagcctgggcaatagagcgagactctgtctcgaaaaaacccaaaaaactattctgtaagatatataatgatgaatatatgtcattatacattggttaaacccgtaaaacgtacaacatcaagagtagacccaaatgtaaactttgggtgacggtgtgccccactctggtgggggatgctgaaagtgggggatgctatgggtatgttggggaggcgggcatgtgggaactctttgtatttcctgttcaatttagctgtgaacctaaactgctctaacaaataaagtctattaaaaaaaaaaagcgaggactggagaaagacatgccatgataacactaatcaaaaaaaggtggtgtagttacgtaagcaaagcaggcatcagagacagtaaagttatcaaggataaagagggacattacacagtgataaagatgaaggagtcaattcttcaagaagacagaacaattctgaataagtacacaggcataccttgtgttattgtgctttacttcactgtgcttcgcagagactatgttttttttacaagttgaaggtttgtggcaaccctgcatcaagcaagtctattggcgccatttccccaacagcaggtgctcatttcgtgtctctgtgtcacattttgataattctcacaatatttcaaacattttcattcttattgtatctgttttggtgatctgccattagtgatctttcatgttagtattataactgttttggggcactgtgaaccacacccatgtaagatgctgaacttaatcaataaatggcgtttatgttctgactgctccaccaactggttgttctcctgtctcccttcctctccccaggcctccctattatctgagacaaaacaatattgaaattaggccaatcgataaccctataatggcctctaagtaagtgttaaaccaaaagctaaaaatgattaagcttaaagaggaaggcacattgaaagctgagacaggccaaaagctataccttttgcaccagttagccaaggtgtgaatgcaatggaaaagctcttaaaggaagttaaaagtgctactccagtgaacacatgtttgaaaagaaagcaaaacagccttattgctaatatggagaaagttttagtgctctggatagaagatcaaaccagccacaacactcccttaatccacagcctaatccaaagcaaggctctaactattttcatttctatgaaggctgagagaggtgaggaagctggagaagaaagtctgaagctagcagaggttggctcatgaagtttaaggaaagaagctgcctctataacataaaacggcaaggtgaagcagcaagtgctaatgtagaagttgcagcaaggtattagaacatctagctaagatcatggatgaaggtggtaacactaaacaacagattgtcagtgtaggtaaaacagccttctatcagaagaagatgtcatctaggactttcctagctagagaagggaagtcaatgcctggcttcaaagtttcagaagacaggctggttatcttattgaagtgaatgcagctggtgattttaggtggaagtcaatactcattaactattccaaaaatcctagggcccttaagaattattctaaatctataaatgcaacaagaaagcctagatgacagcacatctgtttagagcatggtttactgaatatttgaagcccaatgttgacacctactgcttggaaaaaaagattcctttcaaaagattgctgctgactggcaatgcacttggtcaaccaagagctctgacagagatgaatgttgttttcataccaactaacacaacacacattctgcagcccatgaacaaggagcattttcatctttcaagtttcattatttaagaggtacatttttgcctgtggtcccagctacctggaggctgaggcaggaggactgtttaagtccagaagttctgagttatagtgcgctatgccaattgggtgtccacactaagtttggcatcagtatagtgaccttctgagagcaagagaccacaccaggttgcctaaggagaggtgaactgcccagtttggaaacagagcaggtaaaaactcttgtgttgataagtagtggtactgtgcctgtgaataacactgcactccagcctgggcaacatagcaagacactatctcttaaataaattaaaaataataattaaaaaattttgtgggccaggtgtggtggttcccgcctgtaatcccagcactttgggaggctgaggcaggcagatcacaaggtcaggagaccgagaccatcctggataacacggtaaaaccccgtctctactaaaaatacaaaaaattagccaggtgtggtggggggcgcctgtagtcccagctacttgggaggctgaggcaggagaatggcgtgaacccgggaggtggagcttgcagtgagccgagaccgcaccactgcactccagcctgggcgacagagcgagactccgtctcaaaaaaacaaaaaaacattttgtaagctatatcagattcctctggcagatctgggcaaagtaatctggaaagtattcaccattctagatgtcattaagaacatcagtgattcatgggatgtcaaaatatcaaccttaacaagagtttggaagaagcggattccaaccctcatgaatgactttgaggggttcaagacttcagtggaaaaagtcattacacatgtggtggaaacagtaagagaactagaagtaaagcctgaagatgggactaaattgctgcaatctcataaaaaacttgaacaaatgaggaggtgctagttagggaagagcaaagaaagtagtttcttaagatggaatctcctggtgaagatgctgtgcatattgttgaaataataagggatttatttatttttattttgagacagattctcattctgttgcccaggctggagtacagtggcacaatctcagctcgctgcaacctccgcctcctgggctcaagggattctcatacctcagcctccccgagtagctaggactacaggcatgcaccgtgacaaccggctaattttttgtatttttaatagagatggggtttcaccatgttggccaagctggtcttgagctcctgacctcagatgaaccacccacctcggcctcccaaagtgttgggattacaggtgtgagccactgcacctggcctttattggcatacattgaaatatcatgccatcgaaatcctttttgtaaggttggtactaatgcctcctttcatttctgattgtatttatttatatactaatcatactttaatacaactgtatgtcgggcttttttcaaataacattccatctgaactatttttccatagtacagtcatcctttggtatctgcatggggattgattccaggacccccaggagatatcaaaatccaaggatgctcaagtcccgtatataaaatgatttagtatttgcatataatgtaggcacagcttccaatgtaccattttttttttttttttgagacggagtctcactctgttgctcaggctggaatgcagtggtgtgatcttggatcactgcaacctctgcctcccaggttcaagtgactctcctgcctcagcctcccaagtagctgagattacaggcacgcaccaccacgccccgctaatttttgtatttttactagagacgaagttttgccatgttggccagggtggtctcgaattcctgacctcaggtgatctgcctgccttggcttcccaaagtgctgagattacaggtatgagccactgagctgagcccggccagcctcctatatactttaaataatctctagatcacgtatacatagtacaatgcctaaaaataacttcatttgcatggattcaaagtagtacttggcatgtagcaaattcagtttttgctttttggaactctgtggaatttcttttcccaaatatttttgatccatagttggctgaatccatagatgtggaacccatggatacagaggggcgcctgtactttggtccttataaacattaaagagaggcacaacataatgaatagcttacttcctcaacacctctcttttgaagaagttggtaaatgtttctcataatgctgtgttaaacatctctaaatatgacagactccctggatcacaggtgctatcactgatcttatttcctcaaggagttcaccatgagtgaactcctgtctagtatccaagagccctcatccctgcctgccttcccactgctaaccagcctctggcctgttagcccctcctctgggcactgtcttcagctgttttccctgctagtcacctgggtcaaagaaatgtgggcagatacacacaccagcgtgtagaatcctggattcttttcatttgtatccatgtgaaaaactgggaagacaagaggcccatgacgctgctctgtgaaactgaagtgtctgttcccctttcttctaatgtcctacaacagggcaaagcatccatctgtgggtgtagcttaatattctggaagtcctgagtcagtgctcctcaaaatcctttaaaaatttttttttttttaaatgtcagacatttgcctcttcaaagagcttgttttactatgttgtaaaaatcagatcatgtacattttcatattaaattttttgttaaataagcttttggaacagtcaaaaatgctttctctcagatgttctgaatatggaaatggaatattagcttgttctaattttttctaacatgaattttcctggttcagactgatctgaaagggtttcatgtattaaaatgagagaatcctattgtgaaacatggaaaaaaagtcagacttttatgtaactatcgttttgtaaaatacagcgagaatgtcacagcaacgtccaactatcatctaagtttctaaggcgggcggtggcttcctgagctcaccacagcactggcccatgacatacacttgcttggcactgccgagctccagctgctccaccctctctggttgggacccctgagagcccttaggagtctccccacctcctgcctctgccagatgccccattcagggactctggggccagtggcccactgggaactgcacctccccagcctgcatgtgggcttgtatcagttgttacaatatccctgggagcaccaggtaaatcgatctacagcagttgcccaatgggtctagacatctgtgaagcaagagcacagctggccagggctgccccccttacaaatgggctccatcctaggttctgtctgctcaggcctacttgccctgtagtcacttacctcaggtccctacgtgcttctgcctgacacctggccttaggagagggtggagcagaagacccacagtttcacccagggctgctaccctgtacctgggatgctagcatttggctcccaatccacctgaggctcttggctaggaagtgccagtcaggttgcaggggtctcactgcccaaccactgtgacgcacaatgaaggaacaacagcaggagctgacatgtgctgctcaccgtgaggcaaggaccaagatacggctttacaggcctaaggttaagggatacctcctatgaggagagttttcctgggaggtccattctgcctgagaggagatggactcagaaagaccatgtgtctcaagattatccctcctccctctctgaggaagtgggggacctgggcctaacttgcaaggtgtattactttgcgcaccacccctaaccactgcatgacactgtgcctcaaagaaaatctccactgaaggccaggtgcggtggctcacacctgtaatcccaacactgggaggccgaggtgggcgcatcacttgaggtcaggagttcaagaccagcctggccaacatggtgaaaccccatctgtactaaaaatacaaaaattagccgggcgtcatggcatacacctgtaatcccagctactagggaggctgaggcagaattgcttgagcctgggagacagaggttgcagtaagccaagactgcgccactgcactccagcctgggcgacacagcgagactctgtctcaaaaaacaaacaaacaaacaaagaaaatctccactgatgggtgttttcttgtttcgttttgtttttgttttttgagacaagtcttgttcaggctggagtgcaatggtacaatctcggctcactgcaatctctgcctcctgggttcaagcgattctcctgcctcagcctctcgccactacacttggctaatttttgtatttttatagtagagacggggtttcaccatgttggccaggctggtctccaactcctaacctcaggtgatctgcccacctcggcctcccaaattacaggcatgagccaccacgcctggcctgttttgtttttattcttgttttgagacagggtctcactctgttgcccaggctgcagtggagtgatttctgcttactgcaacctctgcttcctgcgtttaaggaattctgctgcctcagcctcctgagtagctgggactacaggcacgcaccaccatgcccagctaatttttgtattttcagcagagatggggtttcaccatgatgaccaagctggtctcaaactcccggactcaagtgatccacctgcctcggcctcccagaatgctaggattgactacaggcatgagccactgcaccaggcctccagtgatgggtgttttaaagggctcctcctggttttcattgagaatcaatacaagaaaacagccacatcaagaaagtatctgcattttctgtaaggcctttgttaaagatactgggacttgttttatttcattttcctcatataaggatccaacccaacctgagaattcagcaccaggctcctagaagctcactatactcattctggctggaaagcaggaagctcagccccaagtgaatgctcactcactgccactttcaagtgagaaactgaggatgacaaatgtgatggtggccccttattatacagatcttgctacagctgtatttatggctggacggtcttgtgagaccctgtggacatagctgctgaggaaccaacccttgtggcaccaggacccaggatatacagtcaagattctgtctccagaagccaatctaagggctatcctcctggcttctcattcagggtatgcactacatgagagataagggccacagaaagccacaaagcaaacatgagtgtcttcctcaataagcaggactgtctgtggcacactgtagtttctctcaggtggggaattcattttatttattttgttcagaacttgctccatttcaaaatctgaggtttcttcaccttctggtaagcctcttaactccctcttgacaactaccccgcagcacatcctcctggggggactcctctctattgccctgtcttcagctccacctcctcacctctgtgccactctggccaattttgtagactgaatgttcttttcagctggttctgatctgctctctgaaatgcttgttgacttttaaactgcaatgattattatttttcttttctaaaagtattttttttggttcatttccaaatctggtttttttttgatagtgtattattcttttaatttttattgagatatatatatcataaacttcgccactttaaagtatagaatcattagcttttagcatattcataaggttaagcaaccatcatcactatctaatgccagaacattttcataattccaaaaacaaactctgtacccattggtactcactccttatcctccctccctcagaccctggcaaccactgttactctactttctttatggattttccattctggacatttcctatcaatggaatcatacaacctatgatcctttgtgactggcttctttctcttagcataatgtctttaaggtttatcgttattgtagcacatgtaagcattccattcctctttattgttgaataatattctattgtatgggtaaaccatattttgtttattcatcacctgatggacttttgggctatttccactttttggttattatgtacagatgtgaacattcatgtatgagttattgcatggatatatgttttcaattctcctgggtatgtatctaggtgtgggaactgctaggtcagatgataactctatattttaccatttgaggaacttccagactgttttccaaaggtgctaaaagactttacattcctaccagcatgtatatgagggttccctttagagctaatttttgtttacagaatagagtattaatctttcctcacattttgttttagctttcatgtccttcaagacttaagcatactttatagtgccatctgacaattctatgatcacaggtttataggaccaacacttattatctgactatctgatcttttaattacagacctccaaatgggtatgaagtatttcattgaagttttgctttgtatttccctgatggctaatgatgttgattgaatttttatgtacctgtgctttgtatatattctctgcagtttctcttcagatcttttgctcatttttaagctgtgttattcgtctttttattgttgaattgtaaaagttatttatataatttaaattctggactttaattagatgggatttgcaaatattttctcccattctgtaggttgtctttcaattctgatagtgctttggaagcaaaaaagcttttaattttttttttttttttttgagatggagttttgctcttttgcccaggctggagtgaagtggcgtgatctctgctcactgcaacctctgtcccccgagtttaagtgattctcttgtctcagcctactgagtagctgggattataggcgcctgccaccatgcctggctcatttttgtatttttagtagagatggggtttcgccatgttggccaggctggtcttgaactcctgacctcaggtgatccacccacctcagcctcccaaagtgctaggattacaggcgtgagccaccgtgcctggccaagcttttaatttttaacatggttttgtaaagatgaggtcttgccatgttgctcaggctggtctgaattactgggccttctgtctcgggcttccaaagtgctaagattataagcatgagccattgtgtccagccaaaagttttaaattttgatgaagtccaatttatcgattccttcctttagttgtttgtgcattaggtgtcatatctaagaaacagttgcctaatccaaggtcacatagatttctatctatattttcttctaagagttttatagtttttgctcttacatttagttctttgttcccttttgagttaatttttgtttatagaatacagtattaatctttcctcattttgttttagcttttgttccaattttgttttagctttcatgtctttcaaaatttgttccaattttgttttagctttcatgtctttcaagacttaagcatattttatagtgccatctgacaattctatgatcacaggtttatagaaacctaagtctcccagtaagtatgtctcctgacatttgtgcatgacaggctctttcttcttgtgactgtggattttatgatcatctaaacagtgctttatcagtggtaatgctgtacaccctggcccaaggaatgtcactgcatggtggatacgcatctctgccaagtgcctctgaacgtcaattagaccaggatttcgtttgtgttcatttctcggcttggcgatttctatacaacacaagtagtattaaactggccctgaatccacatgagggcagacctgtggttacacagtctcaagggaagactgttatcccaacccaaaaacaggctgagacattccaacttctctgctagttcttgtgctgtcagttgggttttcccaggtctgcctcagtccttttttaagcagcttgactttatgctggtgacttaattccaactcctacatggcttagaccccaggccttgtctcaagtcgatgtggtcattaaaactcaaggtcctcagtcaagacccctagccttgcacccatggtgcagttctgctcactgctctggcttttttgttcactcttagattttagactctgggtactgctctttcctgtgaactagttattcattttagggacgagggttgcatttaatccagcatttcaaagtatttagaagcatggagaccgcgcgcggtggctcacgcctgtaatcccagcactttaggaggctgaggcgggtggatcacctgaggtcaggagtttgagaccagcgtggccaacatggtgaaaccccatctctactaaaattaccaaaaattagccaggtgttgtggcaggcgccagtaatcccagctacttgggaggctgaagcaggggaatcaatcaaacctgggaggcggaggttgcagtgagcagagtggctaggacaatagacataagccacaacacctggataatttttctggtagagatacgggtctcactatgttgcccaggctggtctcaaactcctggcctcaagcgatcctcctgtcttggcctcccaaagcatttgggattacaggcatgagctatcgcatgtggcctgcattgagttaattatgaaacaagcatgattagattacagagcagactacaagattccacaccaagtttatagatacagcatcaaacttgcagaaagggtcctcccatgctagcttccaggaactgttttccaaggagaataaatcctgtccagacatgcagttctggacagggcttttcataagcaaagccccagaggtagcatgctgtggctttagctccaaatcaccatctactgcaaggacaggtcacatacaaatgctcctttcattgggcacctgctggctgtgtggctactgcaagtttctgaccagtgtccttgtacttggctgatggtggcacaggctagggtgtgtctgcccagggctgctgagccctataaacctcgcagtggggtgcaactcttaagggacagctcttaagcccccaaagtccagcccacatctgcctctcctctcctaggctctgactcactgggatgtgaacttagctccttgtcaagctaggcttggagggaggggccctctcaggaggcagagaacttcagtgccaatggcagaggctgcagacattcgctctggccacctcaggaggatgcactactgcaaaactccaagaaataaagaactacaacctgcgtgatgtcacagctgtgtttgaggggagacccagagaatggataagcagcatagtgtccacaagagctcagaagccaatctgacttgacaaagacctcacttacatcatttttattgcagctctctacctctggtcagtttctgagtggaaggccgtcacttccatgatgtatcaatatcagagtcttccacctctccaactaatctcatgctctcttccgtgcaaactctgggctccatccaaacaccattattctcagttcagcctctgcactgaccaatccttgtgcctttgaccttgtggttcttttgccgcgtcctcccccatgactccttccagccaccttcccacttcaaggaaccacctctttctcctggtggctcactaagggctctgcagtcttgctcccatgtattgagtggctagagtcttttccccaacaggaaggcaggttgcttggtgggaacactgccactgtgctgttgacccatgcctgcaccctgcctggtccttcagggtcctgcagctaccacctacctttccacagctgtcggagtcatgctggtcagggcaggagcacctggtgtggctttggaccgctctgtgaaccgggagtcaaacgctttcatgggttcgatcttggacggggtcgttaacacagaaggtgacaatgcagcaggagtagaggtagcattcatactggggtgaagaagaggggaggcatgtcaagcgcaatcctgaaaggatctggaggtctagtatttgcattatttggagcctactaaaaaaggcacaaatatcaaacttccataaacacaaaaaatgtcaagatacaatctactactcccatttctttaaaattttcatgtgtcaaaattatggacacctagaaggttgtgagcaaatgcattcacatttccccctttgcactgttctgagagcttttgcgggtagaatgaggcctagaacatggttcttacaacccttttctctagtcacactgccctatctccacaacttaaatacagcacctctaccccaaaccactccagccactcacctttcccactttgacaatgagtctcatgagataagcctgcacctggggtcctgaagccatggtctgcttttacccttagtcaggcatcctccatcctgagcggcccctcccatatctccctgtgacagtgtcacattcttagcattatgctccaagtgctcatcacacaactttcatcttctattccacagagaaaggagaggccaggcagaagcctgcctggtccatccttcatgtccaagcccacaccacacgctttgggaccatggccactggacctcctcctaagcacacccaggctaacaccttccactcctatctgcccagacaccacaccacatgcctggtagtcaccctggacagccccattcttctcctccatgatctgtggccactagaatgggccatccccacagagttctcagatctggcatggtctgtccttcccaggctcccttcgtcctggcatgctttgcttcctcactggtcttgctgctcagtcttctcttcctaccctctcagggtccccccagggcagtgacctaatgtttgggcatgccttcacagccatggtgctagcacccagaagtaggaggctgaagtaacataagactccattccaccaatggagaattgctctgacggtatcagctgtatcccagaagcagggggctgcagtaacacaagactccattccaccaatggagaatcgctctgacggtatcagctgtatgtgccagggagtggcctatttggggcaccaccgcctaacagagtcactttcctaaaatggagatctcaaagccttctacgtctccactctggggaaaagcccagactacctgatccagcacagacaccttggccttctccctcttcttggccttcctcaggggactggggggctgctgcccctaatccccaggcctcatcccctggtaggcctgtatgagtcctgtggagggtaccctctgaggcacctccctgatccctgagataccagcccctctttggatggctagccatttctatccaggggacctgaggggccacctgcaaccctgtggctacctctcccccaccagcctacacactccctgaggatgaggacccacccattaagcccctgcgatgcctggggcctagcagggtgtataacccagagcaggtgctgagcaaacgttcactcctggctttcatttgtgcttgcctggttctttctgatttctaatttggtttccaagtaacaatgggtgaggacacaggctctgtgagtgaatataattctgagagtataaggggagtctgtgccctcccacaggagaaccctgcctaagatgaatgctgtgtgatgtgctcagcagagtgaagtggaagctgaggccccagaaatgtgaagcacctccagtgtagagctgccaggtggggctgaccctgcagcacgtagcatttcactggtagttcccacccttagcagcctgaccctcggtcagccttgatacactctgtgaaatcctcaacagtcctgtgcatcagagactcactgaacaagtcctcccctctgagaagtccccatttcaaatcacgcatttttttctttcttttttgattgaaggggccacaaagtgcaaacagaataaaattctctgtcctcaaaactatgtgcaaacctgaactttccccagggacaggaacaagccttggcacccactaacctgtctttattgacagaatcgcctgcaggtctggcactggcagccaccacaggctctgtgcaaggcttcgaggcgccgaaggagttaggggtactggagtccagtggcagtagctgtggactgctatgagaagagagcatggtgcccgccagggagcccgagagggggatgctgttaaagaatgccgtggagaagtccctgtcatcaagtaagaacaaaagtcagccttgaaagtcaggtgccacatccagtactttatacattcaaataacttttttctaggtccaaaggcagtatgttttcatgatagaaaatctgcaaagttacagaaaagtaaaaagaaaattaaagccacttaatatactatatttaattgaatctaggatttacaggttctatatgtactactaagaaagaaaacaatgctactaattgtcagatgccattgactgtacaacacacccaaatctcagaggtgttaaactgtgcaaacacatgtcttaggaggaatgaaatgcagcaatacagaaagggcctccctttcatgaagggccatggggcatgccactagatgggtgtgccataatatacctaacccagcctctactgagggaccacaagactgtctccagctttttctagaacagatgctgctgcaccaggaagcaaggtattgcagtgtcagaactgaggattctgggacagccaggtctgactcctctgccatttgttagcttgtgacttgctctaactactcttgtgcctccagtcatgtctgcaaaatacaaagtgccaggactctccccatggggttgctgtcaggactaaagcagttggtgtaggacactcttagaacacacattggctgctcaaagaattatgaaattctaataattgtcattacacctaagattcacataatatatgggataaattcttagaagtggaattgtagcagcaaatgaaatgttcactgatgatttggaataaatatttctaaagtgccctcctcagaggtttaaattacaagccatgtatgagagcgcctatttctccacataggtgcttagtaacacttttatcaaatttcttgacacttaacaatctgacagaagaaaaatggtatcttattttgatatgagtgacgttgacattttttctttttcttttttttttttgagacagagtctctcccgccgcccaggctggagtgcagtggcgcgatctcgcctcactgcaagctccgcctcccgggttcacgccattctcctgcctcagcctcccgagtatcccgccaccatgcccggctaattttttgtatttttagtagagacggggtttaaccgtgttagccaggatggtctcgatctcctgacctcgtgatccgcccgccttggcttcccaaagtgctgggattacaggtgtgagccaccgtgcccggccggcagtttttcaaagtagaaatacttgatttccggccaggcgcagtggctcatgcctgtaatcccagcactttggcaggccgaggcgggtggatcacgaggtcaagagttcgagaccagcctggccaacatggtgaaaccccgtctccactaaaaatacaaaaattagccgggcatggtggtaggcgcctgtaatcccagctacttgggaggctgaggcaggagaatctcttgaaccagggaggcagaggctgcagtgagttgagatcacaccactgtactccagcctgggcaacagagtgagacttcgcctcaattaaaaaaaaaaaaaaagaaatacttgatttctttttttttttttttgtgaactgcttgttcatatgctttgtctactgttttgttattggtctttattactgatttgtaaaaatcatttacatattaaaaaaattccttatatggtaggaaatattttacctgggatgttgtgtttcaactatttatggcctttttttttgagacgaagtctcgctgtgtcgccaggctggagtgcagtggcgcaatctcggctcactgcaacctctgcctcctgggttcaagtgactttcctgcctcagccttccaagtagctgggactacaggggcgtgccaccacgcccagctaatttttatattttttagtagagacggggtttcaccatgttggccaggatggtcttgatctcttgaccttgtatccatctgcctcagcctccgaaagtgctgggattacaggtgtgagccaccacgcccagacagcctatcttttaaatgcactaaaattttaaaatttttgtgtactctaaattgtcatttacagaaaacacttttttgacctctgagattataaaaaatattcttccagggaatcttctaaaattttaaacaaaaatattttaaataacaatttaaaaagaaacaaactataagctgtttagaatgtatgtaatgataagttatgaggctgggacccaacattgtttctaggaggtgccatgtagtcctgtcttccatttaccgaattagccaatgttttatcactgatgtgaaatgctacctttaaaattcccataaatattcgggcctgtttcctcatattctatcatattccactgcactatctactcatgtgtcagtatctcactgttttgagttatgacagcttttaagtcttaatttctggtggggctagtcttccctggctaatcttctttttcagaaatatttcggccattcctatttatttttccagataactttattttatttatttatttatttgatacaaagtctcactctgtcacccaggctggagagtggcactatcttggctcactgcaacctcccaggttcaagcaattctcctgcctcagcctccaagtatctgggatacaggtagtagctacagtagctacaggtgggcaccaccactcccagctaatttttatatttttagtagggacggggtttcaccatgttggccaggctggtctcaaactcgtgacctcaggtgatctgcctgcctcggcctcccaaagtgctgagattacagttgtcagccactgtgcccagtcgatttttccacataactttatagttaccttgtctgattcccaaaattcctacggttatttgtactggttaaatttataggctacaagagagctgacatctttatgatgccatcctagctaatcaatggtatgaatttctagttatttctttgagttttctttgaagcctctcagtagggtttttaattttttcttcattaagatatgcatctctggttgcatcctagttattttatttgtgaatatgacttatttctttatgtgctctgagggtagttggtgctacctgacttcatgttgattgtatcctgccatgtgactatcttctttcattgcctatggcagcttttccagttgattctcttataaaccatatcatccttaaataattatcctttccaatttgttctttcctttgactaactacatgggctaggacctatagaacaatgttaaattatagttgcaagagtaggcatttgtttagtttttgaacttaatttgaaataagataatttatcaagttaaggaagcatccacctattcccatttaactgagttttaaaacaacgttgaattttaccaaaacgcctattaagcatcgatgagagatcatataattttttttcttttgatctactgatacgtagaattaaatagttacctaaaatttgaacctccttactttcccaaaacaaacctcacttggtcatggtatattagccttttaacaagcagtaaggttctgtttgttactattttacttaggattttgcactgacattcagaaatgagaatgatcttgaatttattatgttttatccttgtaagattttgatatattatgttcatttcaaaataaaaatttgcacatttcttctccatgcactagaatatttaaaatggtattaacagttacctgagttacctgttccttaaaagttcctgaagtttccctgtgaagccatcttagtccggtggctttggtggggttaactctgtcctctatttcttccacaataatttttcacttttagtaattttattttcttcaaaaaccatccactttctgtgcaaatttatttgcacagagttcagcaaagaagtctctcatctttttgatttgtctattatttctcacttatacctactttgtatatttatgctttttctcttctttcttgattagctaagctaataaggacctatcctgttgctacgtgttagaacgtgggaatcaggagggcaaaaagcttttaataccaaaaggatcaggtcctgatgctagaaatatgcatcctatgtcagaaagttggccccagaccagttaggaagccacctacaccttctcaccaggtaacgcctggaaggatccacagaacaaagtgtcaccatcaccaccaccacctccccatcccacaggcccagtatgttcagagctcaaccacacactgggtctcacttggtctcaataaaaggtaggtaggggcattaccccctacagggtcacaataggaaaaagacttagtcaaaagaaaatgagtgctctgtggggagccagcagacctggttcttgctctactcgtggggacctcagagcctgcacatctaacatgaggagactggatctgtacactgtacgagtgaaggtttctttagacaccaaggaagatttggaatagctcgtggatggacaactgcaaaacgcagaggcctaaagtgtgtggcctccatgaagggcttacaaatgccctgagcagatagacggaatgagaataaaacccagagtgaactgccttgacagtgggggtctatttctttcacacagtgctttatcatttttctttctttttttttttttttttgaatcaacacacatcattttgggaagattaaccaattcaaaaacaatcttcactatatacactgggacaacagcaagtggtgaatgagtctcttcccccttctctgtcccccacagggaaatatgtttgggagccctactctctgcccagtaattccacttctagaagttatcctgagagaacaaccacaggtgagctcaaagactcatttataatcacgagaaactggacacaaacacaagtctacagtgagctggctaagcaaatcctaggatgggaatctggataatcagatagcaaacacctcagaggactagttattaaaatggatgaatgggcatgaaacagtaacgagtggggaaaaaaaagactggaaatacagatataaaaacattaacagtgactgtatctgattatggataatgtttttttcttctttgggcttttactattttctaaatttaaccatgtgtaaatatacctttcataatcataaaaataactttatgaaagaaaaaaaagaaaaaaaaaatcagcctgactgactgctttccttgtgcgtcctctggtgccctggcaacagtgaagtgcagcagatgtgctggccgccttagcactcccacccctcacatgattcaggtgtgcacaagggctccaggaggagtatgggctttgagactgcgggaagctgagcttcacttccttgcttccatgttctaccagtcaggttgtgaaggacccgtgaagatcctcactgtgaaagtgttaaccgctgaaagaagacaggaagatctcgccagataagaccatgaaaggggaatgaaccagtacccagtgtccagctgtgctatgcagagaggcgtgattcttctccggccatctgctgtccgagtctcaacttgtttcttcaaaagattctggcaaagcagagttacataaatgaatgcaaaagttttggccaactatttccaaatattaaaaaataaagtctctttttttcctggtgataagaacactaagcataagatccaccctcttagcaaagttttaagtatgcaatatcatattgtgaactgtaggcactatgctgtaggggagatttctaggacttattcatcttctataacttaaactttataccctttggctaataactcccattttcctctgaccccagtattcaccattctattctctgtctctgtgagtttgactattttagattcctcatataagaggtatcaggcaggccaggcacggtggctcacgcctgtaatcccagcactttggggaggccgaggtggacagatcacaaggtcaggagatcgagaccattctggccaacatggtgaaaccccgtctctactaaaaatacaaaaattagctgggcgtggtggtgtgtaactgtaatcccagctactcaggaggctgaggctgaggcaggagaatcgcctgaaccagggagtcggaggttgcagtgagccaagattgcgccactgcactccagcctggtgacagagcgagactccatctcaaaaaaaaaaaaaaaaaaaaagagagatatcatgcggtatttgtccttctgtgtctggcttatcattaatttgtacacactaagtatgtataactttttatatgtcaattgtacttcaacacggtaggtttaaaaataataaggcttctaaggaaatgtattctaaattgccctcctggtacaactaaataagacacccaagcaaagaacaagcagtgggtacatgccacactggccgcctcgcacaacagccatgggaccaatgaaagggctaaaggactgagctctgtacccgtgaaccacacatctgtcactaagctagggattttctttctttcttttttttttttgagacagaatctcactctgtctcccaggctggagtgcagtggcgcagtctcggcacactgcaatatctgcttcccgggtttaagcaattctcctgctcagcctcccatgtagctgggattataggcatgcaccaccatacccggctattttttttttttttaagtagagacaaggtttcaccatgttggccaggctggtcggaactcctgacctcaagtgatccgcctgcctcagcctcccaaagtgctgggattacaggggtgagccactgcgcctggcctgaggtagagattttcaaactgactttcaaaatagaatccttccttccacagaaagcttgtaactaggggttttctctcatactttatatctgaattgcctggaggaggtttgtcagcctacacaggctcctggagatggtttatactccccaggcaataacgttccctacccttttcccgccccatttccaaccccttcccatcaaacatggcttccagatgaagaagggggagcccatagaagtctcctaagggcagagcctgaaatccactgttgttagcatctaggatttttagaaagaccagaaggataaaattcgtaagttcttacaagagatgacctcctctgggctcctggggataaggaggcctttgataaagaggatccaggccccattactgcatcatgcagcagtgggcaaggggccaacaggcccgaggctggctaacccacagatcccgtaccactctaaacaaaccccttccttaccaccactggtgtctgcccctcaccctgtccctgggcatatgtccatgtctttagcgccaccaggcagggctctcaccttcctgatatcttcaagactctccccgttgacaacgcctgcgactgaggtggctgagcccatctccctggtcgcagcactcttctggtccagctgctgctgctgctgccttcgctggtacttgagcatctcagggttctcaatgacggctgtggagagctgggcctcggtcatgatggctaggctcttgccataggtggactggtgaatgcggctctggggaagcaaggagaggcatgacatgccagcatgagtgccagtgtggccagtgctgcccaccagcaggcaaactacagcagggctctcctggctctgagtggagaagggacccaaggccaactccccatcgcctcccatcctattctgcctgtccctcattcgacagctctgttgatgtctcatgcccacccttgatttttatggcctcccttgtatctgtagctgggatgacagtaaatgagacagccaacaagacaacacctgccccacagtctggtggagaacaaatgacaatccacagtgcttcagtggaaaggaagatactcaaggtgctaacttaaggctcttaaatcactcctaggacccaaatgattttgggaatcagatcctagaacaaaagtctactttcacagctcatctgcagccataagccctgtggttggaagtccccattggcctgcttagtgtctctaagagtatgggaaggcctggcacagcagggctggggagcctcctttactcccacccctcctagtatgtcatcatactcccctccttctaggccctcatagtcttgtgccctaacaagctagacaggagcctcatgagagcagagatggtgtccccagcacactgtagtgactgctgtacatgaaagtgcatgaggaacacacttccatgggatgtgcaaatgtccaatgtgggattctgctcaagaacagggactgtggttaacaggacatctgctttacagcagagcatgggttgagaggcagcgttccaagagaggtgccttgggacctgctcctgcagggcttgaatgtggccaggaacctccttttcttgccatcttggctcctgcccttctctcctgagtctatcccctggaatctcgaagcagaattcagtgtttggccagggtttccctagtgttcctccaacatggagtcccagcctgacttgggaaatggtaagcagatgggttattaggctcccagagtgactccaagggagtgcatagtgatcccaggtacctgatgacagtgacaaggttggaggaggacctgaggcctctgagatactcattccttcatggaaaaatgatggggtggcaggccccattctaagtgtagtcattaaggcagacctctcccccaaaggggttcacattttagtggggaggtcacactgtaggttaagaggaagcttccaccagcaaataaggtcatgaggagagctgccagcctgctctgggctttcacagagctcccttcagacacatacacacaacccaccaagtgggggcaggtttctaagcctctggtaggtgaagcagggcttttctcaaagcctggcagaagggcagagagaccccatcaccccagcagagcacagaggggaggcagcctggcccagaggcagcaggccttgttcactcttctgacctaagggtcacatacagtctgggcaaagagccatgctattttctgaggcttagtttccatatccacgaaatggatgagccttgccttgaagggttttgtgcaatttaaatgaaatcatatgtgcaaaacacattcccagagcctggcagacaatgcgttctaagaaatgaccaatattactaccatgaaggtgaaagtgacatgagcaggggcccctgaggagtcacttcagctctttcccagggcaaaaacctcccagtggatggcctattatcagctcaaaaagagatgcctaaaatagttctactcttaactccaggacttatttctgaaatggggactcgttttttaattaatctattttgtaaagaaggattacaagatataaaagatgaataccccattacatgttaagaaatgacttgtctgtgtatctcacaagaagagggtgtagtcaaaggggtctctcagagctattgtggcaatggccacagagcacccagcagcacaagagccgtcagcctaccttctcctcctcgctcaggggatcgccaagctcatcctgggagaagtcgaggaatgccacagagccgtccatagagcataccaagatgcccagcccattcagagtcctgaaagacatggccatcagcagcctggtagcaagagccccaggcagacacatgtgccgcagtagctggcctgtgaggatggtgggcagtgttctagggagatgctggaaactcctggttcccttctgtggcctggttcccttctttggcctgggcgggggggggagggggcgacaattgtatcccaaagggccctggtgttctttagctctaagcaggtgtacaaaatatctcctttaccatatgttctgtaagaattttcaattttacttatcttacttttgaaactattaaaataaaaaaaacttgacaaagtatacatataaatcaggtcactgagaagcagaaagtgtgcttctgactttggttcatgcactgacggagtaaagtggaacatactaggatcacgtcattctcctcgtcttagacaaatcctgaaaaggcattttccagtggcaaattctacacaggcaggacattctcgcagcagcaggtacaccgctgccagttcccaaatcacgtgcaaacagcactcttggtctgcgctactatgacacctggggaggggccactggccacctgaccctagtcacacccagaaggcctcatgttccaatgtgtggcttctcctttcttaacctattcctgtaagtagaatccaccttaccaggaaatatccatgatggatttgtcaaacagttcatggatgaccaccagcggccgtttcagacatgtgagctggaaggaaagacacagtcaaggttaatgaaattactgaaatccccttctgtattcagctcagttaacataaccaacctagaagcctgggtcaaagtggctgctgatatttaaggcatcttcaactctattcaaactgcagctgcagagatcccaaactgtgggaaccaaagcctgccaaaaatgtgcatgctacctagagtggaccctgcctccagggcttgctgtggtctgacaggggaaatagctttatacacagataactagcaacagagaaggcagagtgggagtgggtttctgaagggctatggtcggaggagagggacagccccagggtggacctctgagagggtctatggagcaggagacacgatgccaaagcctagacaggggatgaggcaccctgagagagaacacaacacatcttccctgggcccaagggactctggtacacatttatccaaggctcattctacactatgtgtaggtagtacagaaatacacacctgggcccttaatctgggcctagttaccgactattaatactttgatgaattattatcttctattttgtgcaaatatttattttattcttcaaagtaagaatttattttattcttcatagttgtgtctgttttttcatttaacacacaataagtatgtcattaaatatcctgtaaaagtctcttctggatgactgcatagcatgcactgtgcatattctctatcgagtcactcaattgctggcatacactctgactccacgttcccacaactatggtaggcctttccacttgtgcacaagtgcctggctaccctgctggctggccctgaactgcaggacaatgggcagggaagaaacacacttcctcacgggatggtgggctcccataggtgctgctgcagcttctgggaggctgtggggctgagcgtcccagtgcagcctgagactgctatgtggggaaggagaagctgtgtctaccctagtggtggagagggggctgaagtctgaacgatctggaacccacattaagaatctcgcctccaccttaattccacttctagaaaaagctgccttgtccctcctctcataaatgtgcctacagacccctcagaaatctacaggccgtgtgactgcctaacctgagcattctaagaaatatgggcatcacagtcagtgatgttttggttgcagcgccacaaacagggcctctggctgggaggaaacagggaaggtcccctgaacggcaatctgtggtactgtggttcaggttccagaatgggtgttaagtgaatacttggcctaaaaaaaaaaaaaaaaatcacaacgcacacagtaatatatttctctataccaaactaataaatgcagccagaggataaccttcaaacccagaacttccaacttgctctgcttatagggacacttttttacaaaatgaaaaaaaaaaaaaattaatgtgtgtgcactttgctttatcaaactttaaatatattggcaccttgatgctcagcaccaagactgctccctgcactgcatgcggaggtgtctcttaccacacagtcaggtcacagcacaccagcccctggcagtgagaaacttaacccttcaggagccctcacttagaaaccgccacagttcttacccttgggttctcactcgccaactaccattgagtatatctgctgagaacctgctctgtagagggcactgagttaggaaggtgaggggaacaatgaaactgaagacacatcgggctgggtgtggtggctcacacctgtaatcccagtactttgggaggccaaggcgggcggatcacctgaggtcaggagtttgtgaccagcctggacaacatggtgaaaccccatctttactaaaattacaaaaaaattaaccgggtgtggtggcctgtaatcccagctattcaggaggctgaggcaggagaatctcgctcgaacccaggaggcagaggttgcagtgactcaagaagccaagattgcaccactgcactccagcctgctgggcaatagagggagactctgtctcaaaaaaaaaaaaaaaaaaaaaaaaaagaagctgaagacatcgcctcatctcaggggatccagcgagtgaggagtactaggctcacaaccttacccatcacagcatcacccaggggtgaaatggactaataaaggcgtcagctttctgtgtgtctttttctgtggacataagcacttatctgtcttggttgtatgcctaggagtggaagtgctctaggtcatatgcttagctgtggtagaaactgccagacagttttcccaagtgctcatgccagcgtaaacacctgtcagcaacacgtgtcagcaatgtatcagttccagcttatcatgtccttgctgacacttggtactatttttttgtttttttttttaattttagaactctactcataggtatgtactcataaatgaaaacgtacatccacataaagacttatacaagaatgttcatatcagctttagtcataatatctcaaaactggaacaatcttaatgtccatcaacaggagactgtataaacaaattgtggtgtattcatacagtggaatgctacaccgaaattataaggaataaaatactgttaagtgcagcaacatacacgaatctcaaaaacactgtgccaagcaaaagaaatgaagacacaaagaagcaagtaccacacaattgcatttatatgaagttcaagagcaggcaaaactcatcagtgtaacagaggccattagagtggttgctttggtggtgagggaggtcttgactggggagggacaaagggacaaaaaggagtgctctaggcagtgatgacactggtgtgtaaacatgtatgacaactcaccaaactgtacctttcaggtgaatacactttatataaagatttttctttttcttttttttttttttttgagacggagtctcgctctgttgcccaggctggagtgcagtggcgcggtctcagctcactgcaagctctgcctcccaggttcacgccattctccgtctcagcctcccgagtagctgggactacaggcgcccaccaccacgcccagctaattttttgtatttttagtagagacggggtttcactgtgttagccaggatggtctcgaactcctgaccttgtgatccgcccacctcggcctcctaaagtgctgggattacaggcgtgagccaccgcgcccagccatataaagatttttctaataggaagcaagcccaacatgctgctcatggcattgaccactgagggtgctgcctgagtctggacacaagagctggtctaggtgggggtcaaggtggcctctcctggctgggcacagacccagtcttcagcacttccttctgggagagcaggagagcctgtgagcttccaaggaggggctgaccccaggtgcagaatagaaatacactcttagcatcacccaaagcaggtctctttcctccacttgctactttaccaacctacacctcccgtcctgcaacaaaagctcaggatagcaggctcacccagacagaaagcgagcggtccttgctgccaacagcacagcagcagtacgggcagctaggcttcgcagaactcccattcttctgcttctttttgaagatttttgggttgaatttctaaagccaaataacagatgttaaaaataattaatcaagcatcaggcatgtcccctgtgcccaagtcccagcccactgaagggagtctcccacagacattctctgagcccaggcactgagcatgcatttcatcttcccgaccacctatgaggcatctggctgatgatggaaaggaagcttagggaggtcagaaagtatgtgcggaggcaccaaatgagtaagctgggaaatgcagatttgaaactagagctaccaaactctccatttctggagcttgccaagtagaagggatgcgtagctactgaaactagccttctcaattccctctggccaggcagggccagccctaggacctgcagaaaagctgagcctgcaagggggcttcagaaacaaagacctactcactccctatctcctaagggaggccaaggggatgggcaggaggggtgtgaatctctgaattccttattgcctcactgcatttgttgttcagtcataaccgtctagcagagatctgctcagtcagagagtcatttgtgatctccctgggccagtgaccatggcaatatcacacaaaggtgcttggttggctgcttagtccagggaactaccccgagagtaacttgtctttgtttctgcaaaggatgaaagcactcactgagctcccagacaccctcctggatttaaaggggtgggcgctctgggaatccccaacctaggacaactgagggcagaagaaggagggttcctgaaagcctggtgtcaggtagcctagagatgttttaattccagagggcaggcaggaatggccggggtgcacagagactggagaagatggaactcagaggcgtgtccctgggcttgctgtctctaacaccaatgaggctgcagggccttaggagctctgtgagccataggcaggcgtcgtgatctcccagagctgctaataaagtggttgtgaggactgcatgggagaatcacgtagagcactaaccatgaagcactgatttccaaagactttagcaacaaagctctggttcaaacaaaaccctacatgaactccaaaacaaaaaaatttaataagtaatattttattcatataaaatttgtgttttaaggtacaatatatgatacttattatctttttttatttttatttttgagacggagtctcgctctgtcgcccaggctggagtacggtggcgcaatctcagctcactgcaacctccgcctcccgggttcaagtgattctcttgcctcggcctcctgagtggctgggattacaggcgcatgacaccatgcccagctaatttttgtattttcagtagagacggggtttcatcatgttggtcaggctggtcttgacctcctgacctcatgatccgcccaccacagcctcccaaagtgctgggattacaggcatgagccaccgtgtccggccgatacttattatctatttaaacacgggcaaaagtgagtctattttcatcagggtcttggatgatccttcacttttatcaaccttagtccaccaatctgtttattttatttggctgcccagtgttgagaaaatcctggttctcacagattattcgcaactacttaacagcttgccttgggctctgtcaggacactatttaattaaagtcatggagaagcataagacgagtggccagacaactctcatgcctaaggactgacagcagttcacgcctctgagctcttcacctgccgcagcaagatctggcagcagctcccaactcagtgatccatggcatggccttgcacctgtggttgatgctgccaggtgtggggacaagcacagtgcttggtgggtataccagaattgtacctgtattcactggagccaggtgagggtggcaccgtgcttgggcaccccaagcatacctgagtgtgtaaaaggctgatgtggagctacgatgttcctaacccaagactgattttggtgatgttcacatgtaaagtttgccaataaatcaaccaagtacatactctattttgtaaaattagcttttaaatatttaagtataactattcaaaataaaccaagaattaatatttgctgaatcttggagcccatctccctttagttccctgggcactcaccacgacagtcacagctttccggtgcccaacaaagtccatgttggtcttccatccctcccgttcgatgatctgggcagtggggcctgagttgttcatggcatgggcagacaccaggtaatgcccatcaggtgaccagctgagccgcaacacatgggtcgttcctccacactgaaagaagcatctgcacttgaaaggagctcaaggccacctttgtgaccaaaactctggcctcgaggataaagttaaacttcaatttataaatgtgtgatggtggagcatgcaccccaagcttctggctacactgacagcttctgtctcaccagatggcccaaccaaaaagggctctgtgaaatgaatttggaaactgcagcatcctacactcccccagaggagctgaacaaagaaatatagtacagaagtgtatgccctgaggagatctgcaggaaggctacctgtttgaaccatagcctctgcatgggccaaatctctctggccactgacccaattcttctgtgtagcacctgttaacccacagcatggcatctgcacagcatcctcaagatatactctggtggagaaaaagccctttttaacccaggagcctggcagaagcctgtgtctgtaatgtagctgatgactgtgaggcaccacctactctcttgagcctgttgcctcacccaaagggtggtgaggatacccgcaagggagaagaggtttgtaacatccttataaactataaaaggaacagtagaaaggcactgctcccccagtctggactgggggctgaggcagagcatccctccacattatccctcctgcaaaaagagatgacatgggtccagagccagctccttgaagctcaaggtgggcccagggcagctctaaagacttaagggttaagatcatgacctcacagctctagagcaggacatgacaaaccagagcctgagtatagtgaaatcacccacctcagctctcagcctaggtgacagaaccaccccctacctggaaggatgggcccacccagtagaggctgaagagtactaccacctcctgctggtactcaagacactcctaaagccgtccctaggagtccacctcatgggaccccactgcctggcagtcagagccctgaggaactccagaaggagcaaaagctccttagggcaagactaagtaaggtaaaaaccagtactcatatacctagcccaggagctggtgttgtgcgggaagaactgaacatatgactatcactttacttttgcagccatcctgaccagtgggcaaatgcgtgctcttcctgcaaaccttccctcatgtgtccctcgctctgtgaagtctttcctgatgcactcacctctcctgggctgtttctgcactctggacaactccattatcatgcaactaatgggaatgcctgtctttcctatggggctttaagcttcaagaggagagactccatctcaatccacttttatttccctgtgcccagttattgccttctatacagtagacacttaataaatgtctaatgaacaatggtgatcttgagctctcattccatttgaaatcagaactcaaataacggaagagagattaaaataccagagaagctactgcagtctgatctccaaacatgtgcaaactgtactgctaactccagccaggaaaaaaggcccctgaactgcagggtgcatatcaacaagcacagcacagtcgaggatggcacaagagtctcctccatcctccccaacaagctgctctgcgggaggctcagagtaaactccgcactataagaagcagttttatccacgtctgtgggagtgagctgggtgacagaatgatgtggagacatctctaaggttcacttcaactttaaacctataaatccgggccaggcgcagtgactcatgcttgtaatcccagcactttgggaagctgaagcgggtagatcacctgaggtcaggagttcgagaccagcctggccaacatggcgaaaccgcatctctgttaaaaatacaaaaattagctaggtgtggtggtgggcacctgtaatcccagctactcaggaggctgaggcaggagaatcgcttgaacccaggaggcggaggttgcagtgagctgagatcgtgccactgcactctagcctgggcaacaagagcgaaactctgtcgccaaaacaaagcaaaaaacaacaaaactataaatcccttttatttcaaagttggaaattaaacagcgtctcagaaatgaaggattctgtattatctgactcttagggccagagtcccaccccagagagccttggtgaatccgctcaggcccccggactctgtgcattccccaggtggcctggcccatggccagctccctctctgtacacagaagtcaggaagaggctggggcagctgcgggggctcagctccctgagctgtccccacttacctcatcaaaaggcttggtgatgctggtctccaactgccagtccagcgtcctccacacctttaggctgcggtcatcagcttgagaagctatgtatttaccaacagggtcccatgtcaaccctttgaccaagccagaatgacctctcagagtagctagaatttctgtgaagaaaaaaggaatgtggagaggtgttgtctgagggaaacatgacctgcaatccatgggccatgggatggatatgcaagagaggggactcagcagtctgccatggccagcccccacaccagacagaagcagaagggcctcctcatttgatctccaccaaggcaaaagccaattgaagaaatgacagcatcaaggaggcaggcaccaaggggctagttctgatccaggtcttatctgtatctagcggccctgcctatggctgcccttcctgggctgtgacaccagcacttctgacgttagcctccctggtagctccctgataaggaggaggcctactagctcaaagggcctgactgtggctgagtcttttataagttatggctgaagacaaaggtgtgtacgacggtaccccatatagatctgtaatccaaatgctactccggtctctaaagcttccctctccatagccagactgagtgtttccacacatgctggtggctttcaaagagttaaaatgacctggatccataaggaaagcatacttcaaatacagagctgaaatatgagaagaattttactagttataaactgcagcactgtgccaggttatgccatctgttgtgactttaaacacaatgaataagaaaaatcaatcttttgcaaaactgggtttgtgttagcccgtatctgctcaagggtttcacagaggagatggtgactgagctgagcccagagcccagtggtgggggtgcacacagcaggtttaggagcatcagggtccccaacaacagctgcccatccattaccctcctgatctgtggcatgccatgctagcactcagttaccatttttcttaagcatgaatctctttttaaagcttaaacaaatgtaactgacaaagaaaaactgacaagacacataaatcctaggccactgtgacacatctgttgccaccaagactaaggagacagcccaacccctgctccagaaactgacaggcagtactgcttgctgttaaccagtcagaggaggccccagacctgggaactttacagcattccagatgacgacagtgttatccacgctgcatgaggctagccaggcatcgtggggagaccatgctacatccatcacatctgaaagaagacagagggttctggtgagatctcttacctggtgatgcccttgtctattagcttggccagtgcccctgggacctgggaccatcataaccactctggtattttttaaccaacctgaaaaaactccccccagaatttttcaattggtcataaatttaaagcatctaaccgaccccagtgcctcactccttttacagacgaagcaactgagggcgtggttcagagcttgggcaccatatggcaccacacccatgcatgagagcctgctacttcgtgggtctgtggcctggagcatgctcctcagccctgctgacttgctttgccaatcataacagggccttcctccgagagccttctgagcatgagacacagtgggtaaagcacatggcagaatgcctggcacagtcagaactccagggctgctgacaactgaacacaagtcatcttgaggccctcgtctggttcatggactgggtctcatctcccagaccctgacaggagtaccccttcactatggagcctccaaacagaattattcacattcacttctttgtgactccattttatcatttgttaagtgcagattaaaaaacaaaatctaggccaggtgcagggactcacgtctgtaatctcagcattttgggaggctgaggtgggcagatcgcttgagcccagaggtacaataccagcctaggcaacatggcaaaaccctatctctacaaaaaattggctgggcttggtagcacatgcctgtatccccagctacacaggaagttgaggtgggaggatcacttgagcccagggaggttaaggctgcagtgaccatgattgcaccactgcactccaggctgggcaacagagtaagaccctgtctcaaaaaacaaacaaaaaaaccaatgaaacaaaaaaccccaaaacctatcctcatagggtcactgtaaggattaaatgtgataaactgctgcaacaccatgccaggcacacaccaaggcatcgatgagggtccgctgtgacgatggtgccaaccttgcctatcctgccatcaggggtgaagggcgcagtcttagttatttctctaacctcagcgcctggtgcagtgctaggtatacagaagaatgattggtgagttgaagaaacaaacatagcagcaaggtaatagctatcaagtcctttctttgtacaagaggtttaagcaaaatattccaaatatctattgtattttttccagttaaaaaaaaactatagtaacagcttaacaggtttttttttttttttcaaattgtctcacatgctgtggttcacattttgtattctaaatgcctatgtgatcttcacagcttctttccttttttgccctgcattctatgtggttgagagtattcactactattaattgacctaatttaacactgaagattaactggattctggttttttgggcccgtgtgtatttgtcactctccatactccagattattactctgagacgcataccctagagtgggaatcctgggcagaatatctgagcatcctcataggtctggattctcataaaactgtagactgcttttccaagatccctgtggttttacatttctacatgcagactgtttgcttcaaaactcccttattagcattgaggatgatgactttttccccttccgacttatttattcaatacaattttatatttaaaatttttaattagattattagtgaaagcgtttgtctcttatctaatgtgtttttggactgatttgctgacttattgtgaccatttactgggaagtgtttcgggcagtgggtctaacaacataaatgcagtgcctacaaaaatgaagaaaacaacaactttctctagtaactgagagtcctggaggggcacacatgcaaacgccaggacagcaggggagtgcccacatcctagaacagagaatatgtggttaggtgggagcccagaaaggagaagggattttcttagcaatctccacagacacatataatgcagctattaactgcaaatttcacctctctacttttttatactgtagtagttttatggagtaaagtctgttattctcctttgtgatttcttctattgccttgttaaccttgaaaaatattctctctgctagaggtctggtaaatattcaattctattttttccttgtgtagttatttagaatgtttctctctttagtatctggtttggtgtgtgctgtatttggtgaggattgaaattaatttctcctcactaactgcttaacagttactatgctccatgtgaggaagaatccattttgataagcgatgcctcctttcacaacacaccaacttcttaggtatactgtagcctctttcagtgttacgagtttaccctcaaacccatgatgtttctatcactggaactttgaatgttttcatccgtaacattcttatccttccagatacgatcctttagaatcactgctgagtaaatccacatacatgacataattttctcctaaactcccagtttggagtttctgtcttcagactatatagcacctcctttttatggtgcatctacacacacaggagaccctcccctcacttgtagatttacatttctggccactgttctcaccatcattcttggtgactccaagaggatgattcttctaacactccaggctcttggttccttaaattcctccttcccttctgatgaccgtggcttccactactttcaccccacggtcatgtccagaggccttccatgacaaatcactgcaatctgtctcaattccaaccttcccacaggccaaccatcagccccgtgctcctagctcaccctcagctccaacagcactttcacgccaccaggaactccgatctactgatgctgccgtcccctcaccacttgccaaccacctggtccttacctctctcctccagctgagagcccaccaccactcccccttttcttctcctccatcttcctacacgcctgacaaagctcagctcctctcctagtgttttttgagtactctccaatgacacctttggcccaatgacaccacatgaatattgcacttgcctaggcccccagcaccctccatgctgtcaagcccagcagtctatccttggtcttcactttgcccctcagcaataagcaatacgctgcctgttcccctctccttcaaatactctcttcactgtccgttttgttgttgttgctgagacagggtctcgctatgatgcccaggctgttgagctactggcctcaagtgatcctcatgcctcgcttcttttcactgtcttaactggcctctccttctagcttctttttctggtttcagctctccaatccctaggctcatccttggactctgctcatacccagaacctcatatttccaagattcatatttccaaatgtctacacagtatgtccatttacactggcaaacttaacatatccaaaaccaaactctgaaaacacttcccttaacaaacatttctgtcccacctgcagacttcctgcttcaggttacagccactgcatcctttccactgtttggaccatagtccgggaagccatcctgactcctctgcttatctcacatcccatattcaatgcaccaggaaatccgcctctgatcacttctcaccacttctgtgttatgactccaaaccaccattgtctctcccttgtttttcggagcggctcctttactagtcttcccagtgcagccctgagacccccatggtagaatccacactgctgccacaggtctcaactcctctgcctagatccctgcggagacttcatattcttgctcagagaagagcctctgccacggtctcaaaggcacactgcctcccgcaccctcctcccccgccccagctcccaggggttcactgggcacagtaagcacatgtccatgctccaaggccttcgcactggctgtcccctcactgccgtccagtcttccctcaaatgtcatctcctcactggcccccagcactcatcttccaactccttacaggactctgccttctaggctcatcttcaaatctcctatactactcactcgtctgtctcttttacaagaacaaatctccttgagagaagaacagtgcctggaacatggcaggcactcaataaatgtttggtatgtggacaagtaaatattaatttgggaaaaaatgtatttcatctagcctttcaatttaggaagccattttctatctctcaatgtcattttgtatcttaaaacgtttgtgatttaagtcttacaaaactaattcatttcttggtaagattacttattcctggatatttataacttttgatcccactctgtataattctctttttatcattagatattctaattggctattagtagcaaaagaccaataatttaaaattgttctgttatgaggccaatataaagactcattttattagttctaagtatttttcagtgctttatttgttccaagagctttatccccctatggtttttcctaatatgaaataatgtcaccttcatttcctttttgccttattttccagtttctatttaactgtgttgcagaaattccagagcaacaaattaaatgacagcacccatcattgtcttttcttgatataaaccgcaaccaggcttaactgtgaactgtaatatttgccactggtttgaaaaagactaaggactctaccatgttaaggaaatagctttaggacaggtgtggtggcttatgcctgtaatcccagcactttggaagatgcaggtgggaggatcgcttgagcccaagagttcaagaccagcctgggcaacatagtgaaaccccatctctacgaaaaaaaaaatcagccaggtatggtgatgtacatctgtagtcctagctactcaggaggctgaggcaagaggatcacctgagcccaggagttcaaggctgcagtgagccgtaattgcaccactgcattttgcctgggtgacatagtgagacacagtctcaaaaaaaaaaaaaaaaagaaaaagaaaaagaaatatcttcctatgggcattttaaaaaaagcatttttaataggaactgatgttgaattgtctaatgttccttttaaaacacctaagatgactgtagcttttcccatctaacttcctagtatgtaaagttatattaatagattcccttgtactacacttacaagtcacatttaatcataataaattactattttctggccggtcatggtgactcatgcctgtaatcccagcacttcgggaggccaggacaggcagatcacgaggtcaggagatcaagaccatcctggctaacacagtgaaaccctgtctctactaaaaatacaaaaaaaaagtggccgggtgtggtggcacgtgcctgtagtcccagctactcaggagtctgaggcaggagaatagctggaacccgggaggtggaggttgcagtgagctgagatcgtaacactgcagtccagcctgggcaacagagcaggactctgtctcaagtaaataaataaataaatgagtaactgctttcaagtgttattatatttactagtattgtttctgatttttctatctttattcatattattctatgcttttgttacattatttttcttaggttttcttgtattttccagatacaataaccctggcttatatcttcctttcaattataaatattgctattgttctgtataatttttcttaaaagctcaaaacaatgcacctacaactaatttagaaccaagaagcatttctgaagacagcctttcatttcttcattggttactattctgttcagtttttcctaatcctatggtatcaattatgaaagttcctattttctagaaaattattttttagtattttgttctttagcttaatagtacaaacattatattgtactgtttgatgatttttttctgtctgggttaaatgtttttctagatctttaaactctaattttgtctaggttttttcttcccaacccccaattaaatataccaagtatatatttctcacactttgcttttcaaagatccggttctttcttattcatttacttctgcttttcattgatttttcttcttgaatggttctgcctgcacctgctaccaggaccagtgagtaatgagtgtcaggtccccagctgaaggtggtcaactctacttgtctggtaaaggagccccactgggcggtgggtaggaaagagaatgcaaggctctggttagggccttgtaaaagtcctcacttgaggcctaccccacacttgggcaccctcatagacatgtgcaccaagttccagaaaagtccaactagacttcactgttagtactgtgacacaagtaagggccaattacacaatttaattatcaaacaataacacaacactaaccgtttcagctttcacaaatgtggactcaatctatggccgccaccaagatgggtttgttctccttttaacagtctacagggaatctgctaagcatacactaacaatggattatagctgatgccacctcccacacctctcactcctgccctgtcctcgcccagagctccaggctcaatttgaaggtttcttgacatttcttcccctacccctcaagccaggggcaactccattctgaactggtatccgtccccataagcctgttgtccttagggtctcagcagaggtgatacctctgactatctaggcatccagccaagaatctatctcatacctctctgtgccctatcctaagtattcccaaatcaatctcctcttctctacctcaattatcacaggcctagctcaggccctgacagtgtccatctaaacgactggaagaacctccacttcactgagctgtcacaatgacctctctgttgtgcttcaaagcttttagtggctccctatctcttccatgacaagggactccctcagtaacagggagcacaagctttccatgatccgactctggcatacctgaccagcctcactttgtgctgctccctgccttgtctataaagatccagccatggtgaaatgcctccaaatccccattcacaccaagactttctcacttatgctgtaccaccctgcctggaaaaccctttggtccattcctggaccaaacggactcagactcctaagtcaagtctaaattgcactcaacctggtatccttgacacctgagtgtacagtgcatgggcaaccttccccctcagtctaaattcataaaatgtgcttctttccatgccaagtttatttaaaacactgcaaacatactcaaggtcaagttgagaaacttttcaatgggcatctgtgagctgatttctggggaataaacaaagtgtgcttacggacttagtgatccgctgatgaaggtactgattctgttcagcaggacaaacagcagaacgtgggaagttctacattaaagatataaacatataccccatgagggcaagagtggggagactgaatgcagctggagacaggtagtggacccggtgactgcacagatcttaagggacaggcagggtgtgactgattgtgatggggtgggacagcccagacatagggctgctttaaggaccaaacagtcccacaggggacgtggcggtgctgctgatctgagccaggtgtcaggggcccacccaccccaacaggcagtcccactcaccgcctgaatgattccggaggatagagacacaccgccactgctccacattggcaagcttaccactggagccgaacacggtgctggggccgatgtacctgtgtgagaaaggggccaaaaaggcactcatggagtgctctgggcactgcatagaaatgctccctgcagccagcttatcagggcacacagaacaaagcaaaaacaaacaagaactggaaagcactgggttgttgaataaaaggggctggttaggtgaattatgatccatgcacttgatgaaatactacacagccattacaaatcttgcatgggaaaacgttcacaataagtgaaagaagcaggccacaggacatcacatacaatatgatatcacttatgtaaaggaaaaaaaaccacatgacatggatagcatctatgcatggaaaatggattagaaggacacacatcccaaaatgtcaaaatattaactgtagctttctttaggtggtgtgatgagggatattttttcttttgtatttttagttttctaaattgtatactaaatgttacttatgttggctatttaaagaagcaaaatcaacagtattttatttttaagcatctcacaatgaatcaaatggctttgacatctgaggcagagaaaccacgcgatctataggtactagcccccaccacaggagccagaggagcatcaatcacctggggcctggtggaggcagtgctgacacaccgatgatcagagcctctgataacaccttttgctcttgtagagctcatcacaaatccacagaaagagtgtgctgagatagccaagtaggctgaagagacagcctctgcctctgctcttgaagccacagccacagggccactcttggtgagcaatggtgcagggtctggtgccccagactgactggcccagagacctgggagcaatagttttccaggtgatggttagctccttttgagagtagagcagaggctgccccaggtggggaccaacagagaataaagtaatggcaaagaggctggactctggatcccctgccccagatcctgggcaagaaccagagcaccctgacttttaaccattttgtatattgggcttccatgtgaaatttcacttgaaaaaacaaaagcaacgaagccccacccacatcggcactagaagagatcagactttccttttcaggtgagagcctgcagtcctgtgagggggcagctgaccaggtctcctgaattcctggtcaggctccacctgctcctgacctacatgcactttccactacttatgaggtcagggctatgggaacttcagtgacagggtagggaaaggtgactttgataaagaccagcaaagcagcttctaaaaataaaatgtgaagaaaggaaaatgatgcttacgtagcccgcttccacaccataatcagtttgtcatctcccccagaagctaaatacatcccactgtttgaccaccgcacacagttcacacatgctgggaagaaaaaaaaataaggtgatgaaaatccagtagtcatgcccatttgctttatgtagagtttggcaagatgtaaagggtttataaaatctaatctatctaatctatttaaggcatctactgtgtgagagccccagaaaaacaattcagtttaagcactaacctacttgtgctataaaaacaaattaccagaacagtctggagggggaaaaatatacattatctgagaatcgttagtgctgaatgacatagtcaatagaaggcttctttctaagaaaatcaaaaaatgataaccaaatctcattatttcaaaagggtcatctattaatgagacacatttctgagtagagattattctcaaaaaaagagtacgtgctaaaaagggtcagatgctttttctagatttttcagatgaacagtctgttacagtataaaactctgacttcatctcatctgtcagagccagccctgtcacattcggattttccaaactcgccagcactgcagattgactgactctgcgcttataagctaagatcagcagaaattcccccaggcccctgatgggccagagcctccaagagcactcacaacttggcctttggaagacctgaaagatggctatcaaagttgtagcccccacatggcccgtgagtaacatgctccaggtctgaagacactgagaggcatgttgagaggacaagaacacacagaggaaaggaaggagctgatgtccaaaggccagtgactgttcattaagcatctcaggggtgggaaactaaggcactacagcaggaaaggaaaccatcacactgtctgatggccaaaagggtcctggcagagagcctcagagtgacacagtaacaacctgagatgttttggcaaattgtctcttgcgcacccttccccagaaccctactgtgtccaggtcgctggccccaaagccccatggaatcaggcagtaacgactcatgagcaggaaatcaccagaggtacctgcagactgtccaaagatggttctgtgggcgggccgagtcttctgctgaataactcacccaggtgtgcagccaacatctgtgccttcagacagcaggccgaggggagttaccgccgcacggggccttatctttctaattacaaacacatgtgctaaccttgggcactctgccaacacgcaaagcctgcaaagggccactctgtaatacctaagtgattgtccatctggcaaagcatcttgggaatattttcatccttctcgtcatcctcctggaggactggagacatattccagatcacaaccttcccagaatcctgccctggaacaaaggagcagaaatggctgaatgtgcaaggagtagaaatttgatattaatatttaatgtcaaattaaattaggagaagtcctcacttagcttccataaacaataattaactagatctaaggagactgaatttaaattactaatttaagttacagaaaagatgataagtactcatggggacgaaacggagcggacttagcagtcagcagaagtcaacctgactttacaaaaagaactttagactagcaatcaggagggaactgagctctgatctggcctctaacacggatccaccaggggtccctaaaaggtcttcatccctgcccagcacctagactccgactccttgactcctcatctgtgaaatgaggagaagggaaagtcaatgtcataagaccttttctgttctgtgtacaccctaaaaagcaaacagaaaagcacaccctagtggggtttccctccccttccaggtgctgcctggaatttaggctgttccagagccgactgttttgagacccaaatgtaccctgaacacaggaaaaatggctcattatcttgttatccaccctttgcagttacctacagacgagagaccaccaaaagaggggatttagggctcccgtggtcatgagttgatgtattgctcggctaaaaaatatacccatgccttttagtaatgatttcttttctttttttttttttgagatggagtctcactctgtctcccaggctggagtgcagtggcacgatctcggctcactgcaacctccgcctcgcaggttccagcgattctcctatctcagcctcccgactagctgggattacaggcgaacaccatgacacctagctaatttttgtatttttagtagagacggggtttcgccatgttggccaggctgattcgaactcctgacctcagatgattcgcctgccttggcctcccaaagtgctgaaatcacaggcgtgagccaccgtgcccagccttagtaatgatttctaagctttccatcactgatatctaacgaagtttagcccctcacttaattttcctattataatagggccaaatccaatgaacatgccaaaattaccataaagcatgtttgaaactgcctcttggccaatatgtaaaagtatttccaaaacatctctgctggaccaaggtggcaaaatgtgtgtcttctgggtacaggtgcgaaccctctgattccttcagctaagtccatgtgttctctctcatgtgctgcacctcctcctctcgggtgcagtccacagcatggaaggagagaaaggcttccctgcccacagcttccctacactcccttccagctccttgattctgggtggaagcatctgctggaaacccaccctgcagcacctggcctgaggacctagagctcacaaaggcactctctaagtgctgcctggggaggcctggttggagggaggccccgctctggggtaaagatgacagagggctgggctctgtggaatgctacattgtgtcactatatatacatcttggtattgtggcatgaagaacagctctgtctttccaaatagaaccatgcaacattgcaaaagatgctggctgaagcataagggcaatactaccaataacagtttcaaatggtgtgggctttcttacttgcccacagtgtgctttctctttaacctaactgaattcctttgacgagaaaatgggcctaataactacacgattgctttagaagcttaaattaccctcattcccttttttcagatgagaaaaatgctgacagagcccttgtctctggggctgggctttgcccactggaccacctaccgctctcgatgctctacaagtttggggatacaaactgattttaatattaactcaataaacagaaattagaatgatacatccgctgccaaaatacttacagagagcacactaaagccataaaaggattttgattttattcattcagataacacattataactgtacattttaaacagcgttgcatccatcctgaaaaatagcaagtattccctctacagctaaatggacagcaggagaagagcaaggtggcagggctgttaagctttccctttctttattccataaacataccttgtcctccagttgcgaacttggtcccgtcagggtgaatatcaactgaaaaaatcggcttgcctggaaacaaagaaaaaaaaatacagtatctaaattggcttttattcattgaagtgtatcaaactcaacagattcagttaaagtctaaactgctagaagattctccaaacatcagacaactgaaagtccaacagtgggagaaagcattccatcactgagaatggctgagcccataggatgcctgggcatttgtctgccatcttgtagggatgtgtgtttgtaatggctatgagctgttcatgattgaagttctgagtctcaggtacttagtgaaaagggcacacagctgtaactccagacatctccctattgcatggatctgcacttgactggcagcctagacagaaggactgctatttgtcttttctggctgacagctgagcaggaccagcgctggctgcaaccaaggagcattgcttcgcttgtcatacttctgcttccaaacagccctcttttgtttgtgctgtgaagttcccataccgtctgccatctcagcatctcctctggctgaacctccttcacagtttgtactctatgttaaattagctgttcaattcctccaggagaaaggactgtggctattagttcttagaagccccaaagagcccagtatgggcctaggcttgcactaggatcccatgaagctagctggctggctgggtgggtggatcagaccggcaaaagcactgtaggagcttgaaacccagcagaccatagaaggcactcacgcctggtgggcatttgtccagctccctgcttctaggacaaaggtttaagagctacaagtggcatgtcagttgctgttgagttcatcacatcttcagcctctagcacagtacccagtgtacagtagcgcagtaatatttgttcattgacaaaggagatacatgacaatgatctgagcatcaacaattgctgatatagatgggctgttgccaagagtctcttaattgaacatgttctgtctctgtcacccaagaggaggcaatgtggacacagtaccagagtcaccagccctagaatcactcagcaagtactgggatcaggagtgtgtgggcaggcagtggctgtctgagaactgtgaagtcctgccagggctcccatgcaagtgtgaaaattaaatgctggtgcccaaaaggcactgcccagcatgggacccaggcagcacccagctgtggagagccgcagccatgtagtcaaatcaagcatgaacttgagataaaatacactttccttcttactggtcactatgtagtataggttgagtatcccttatctgaaacacctgggacccgttttaaccaaagggaaatgacagaagtaatgttgctccagttccaggtgtaggccttaagagtctagcagttcaactttggctctctggagaaacctagttgtcatgtgagaagtccaagtaccctgagaccaccatgttttgaagaggcccaagctggccacatgtagagcatcaaagagcccggacaagtgagaatcaaggtcacagacacaggcctggtgaggtgttctatccccaagctattcgagccatcccagcagattccatagagccaagatgagctgaacctgctaagtcctgacaagctgcagaattatgagcaaataataaaactgttattggtttaagccagcaaatttaggggtttgtcatataagagataaaccaaaatgccaattcatttgcttttctgcttaagccagcttgagctgggcatttgtcattttaacaaaaaatgttctagctgacagctttggtcttgacgggcaatcagggcggaacattcccctccccttggagtgcttttcagttccataagtctgtgagacattgtattacatcagtcccctcaagaagcacaccagaaacccttacctgcaagtcacagttcccctgactacccaagagcacgtacaggctgagccaggctgtgctgagggctcagctgcacaagtaaccaattacagcccatgcgctttagatcatgcccactcacagcatcaactgcatgttttctcactcagtctctgtttgcagatttctactatgtgccaggcattaggctaagcaatgagaaagtaaagatacataatcatacaaactcccctagtaagatgtccactgatggacacttcacaagcagaaagccacctgactcagcctcgggcttcctgcagaaataataactgaattgggtcccaagggttgagtaagagttagccagaagatcgggtgaaggagagggttttcaggctgaggggacgcacggcatggaatcaagaaataggctgatgtaatgttgcagagcagactgcaggtagagagtgtgagaaagaagaggagacagagatggctcagcaagcatcagtaaggagctgagacatttctctaaaggtactttcaaggcagggtaatgccaaggtcagattcacattctggctccacaatagcagtgtggaaaatgggggtgggggcctcaaggctccaggggaaggcagggatggaggctggcaacaagtttgggttttggcattaaacatcatgggctgaatctttagccctgccacttacccagctacaaagccttgagattttattttattttatttttattattttgagaaggcgtgcctggttcattggcaccaggtttcctttcctagtgctatgcagattagatgaaatatggtaggggacctacacagataccagcgcagtgctggctccccgcctccttacagcactaggcctttccatcccaaggaaagcagtcactcacattccattagtgggaatgaaactatttatttatttatttatttatttatttatttatagacagagtttcgctctgtcgcccaggctagagtgcagtggcgtgatctccactcactgcaagctccgtctcccaggttcacgccattctcctgcctcagcctcctgaatagctgggactacaggtgcctgctaccacgcccagctaattttggtatttttagtagaaacagggtttcaccatgttagccaggatggtctcgatctcctgacctcatgatccgaccacctcagcctcccaaagtgctgggattacaggggtaatcccggccaccgtgcccggccaggaatgaacctcttctaaagggctctctgaggtggagctaaggaaagggaccttctggctgagctagttagacaactcttcctgtggcacagcatgatgatgacaaagatgagttcccaactacctccagtgtctggcctttctttgtaatagagacagaaagaaaagacaaattaacacaccctagactctagagacaccaagcaatcacctatccttagatcaaccccagatcagaatgttgtccctgcacacccaatacacagccaatatagtcagccactgtctactgtctggggatttgctgatttgacaagagcagcacaaatgctttccacctggcagggaataaagaatacattaaggaagctgggattatgacagggcatgctcaggtagaatcgtaccctccttcacactaggggaaagattcctagaagaggactaaacatgggaacttaaactctgagcacagagaggtggccagaggcaaagcagagagggcacaatggagagctgctggcccttccctctcagcagtcccacagacctttggtttggctccaaaaagtctctgggcttttatgttctgatagttcattgggtagagctgactggaacacatgtgcatatgtccttttggaatgaagcttgggaaagttgaggcttttgcccagtgaatgttgctcctgggaacacttcctgcactgcccaatagaacttggttttaaccaatgttgacaaatttagaattaaaaataagaaaatgtttgaaacatttattaaatgaaacagttacagaacaatactaaaatataaggtggggccggtcatggtggctcacgccggtaatcccagcactttgggaagccaaggcaggtagatcacttgaggtcaggagtttgagaccagcctgaccaacaggcgcaccattgcactccagcctgggtgacagagtgagactgtctcaagaaacaaaacaaaacaaaaaatatataaggtgggtgcaaacaacacaaacttatttatttatttatttatttattttgagacgaaatctcactctgtcacccaggctggagtgcagtaacgcaatctcagctcactgcaacctctacctcctaagttcaagcgattctcctgcctcagcctcccgagtagctgggactataggtgtgtgccaccatgcctggctaaaaagtgctggaattacaggcttgagccaccccgcccagctacaaacaacataatcttaaatgtagaaaaccctaaaaattccacagaaaaactattagtgctaataatgaattcagcaaagttgcaggatacaaaatcaacaaacaaaagtcatctgcatttctatacaccaacaatgaacaatctgaaagggaaattaagaaaacaattcaatttacaacagaatcaaaatgaataaaatttgtaggaataaacttagcccaggaggcgaaagacttgtacactgaaactataaaatataaaacactgctgaaggaaatcaaagacacaaataaatgaaaaaacattatatatgtactcatggactagaagatttaataactttaagatgttaggctgggcacagtggctcatgcctgtaatcccagcactttgggaggctgaggtgggtggatcacatgaggttgggagtccaagaccagcctgatcaacatggagaaaccctgtctctactaaaaatacaaaaattggccggacatggtagcacatgcctataatcccagctacttgggaggctgaggcaggagaattgcttgaacccgggaggtggaggttgcagtgagccaattttgtgccattgcactccagcctgggcaacaagagtgaaactccgtctcaaaaaaaaaagatgtcaaaactcttaaaagtgatttgtaggcttaatgcaatccctatgaaaatcccaatggtactttctgcagaaataaaaaaaaaaatcgatcccaaaattcacatggaatcttaagggactctgaacagtcaaaagaatcttcaaaaagtacaaagttgaggatctcgcatttccttatttcaaaacttactacaaagctacagtaatcagaacagtgaagtacaggcatagacagacacctagaacaacagaatacagagcccagaaataaactgttgtgtatatgatcaaatgattttgacaaggggccaagaccattcaatggggaaagaacagtctcttttacaaatggtgctgcgaaaactgcacatgcaaaagaatgaagttggatccctatctcataccatatacaattaactcaaaatggatcaaagacctgcatatatatcttagaaggaaacataggggaaaagcttcacaagattggatttggcagtaatttctttttcttttttctttctttcttttctttttttttgagacagcacctcattctgtcgcccaggctggagtgcagtggtatgatcttggcccactgcagcctcaaccttccaggctcaagcaaccctcccacctcagtctcctgagtagttggggactgagggcacaaccacgcctggtgcgcaccaccacgcctggctaatttttgtatttcttgtagagatggggtttcaccatgttgcccagactggtctcaaactcctgagttcaagcgatctgctacctttacgtcccaaagtgctaggattataggcgtgcaccactgcatctgaccatgaatttggcaataatttcttagatatgagactaaaggcacagacaataaaagaaaaataaactgaactttatcaaaattaaaaacttttgtgcatcaaaggaaaatatcaacagaataaaaaggcaacccatagaatgggagaaatatctgcaaattacatatctgataagggattaatgtccagaatatatagagaaatcctgaaactcaacaacgtgactcaaaattgggcaaataacttgaacaggcatttctccaaagaagatatacaaatgaggcacggtgcaatggctcacatctgtaatcccagcactttgggaggctgaggtgggtggatcacctgaggtaaagaattcaagaccagcctggccaacatggtgaaaccccatctcttctaaaactacaaaaattagccaagcgtggtggtgggtgcctgtagtcctatctactctggaggctgaagcaggagaatcacttgaacccagggggcagaggttgcagtgagctgagatcgtgccattgcactccagcctgggcgacagtgtgagactctgtctcaaaaaagaaaagaaaagaaaagaaaagatacacaaataaccaacaagcacatgaaaagatgtcaacatcagtaaccagtagagaaatgcaagtcaaaaccacaattacgtattacctcacatccattaagatggctactaacggctgggtgcggtggctcatgcctgtaatcccagcactttgagaggctaaggtgggtggatcaagaggtcaagagatcaagaccatcctggccaacatggtgaaaccccatctctactaaaaatacaaaaattagctgggcatggtagcgtgtgcctgtagtcccagctactcgggaggctgaggcaggagaatcacttgaacctgggaggcggaggttgcagtgggccaagatcccgccactgcactccagcctggagacacagtgagactccgtctcaaaaaaaataaataaataaaaagatggctacttacaaaaaacctcaggaaataagtgttgatgagggtgtacagaaattgtaactcttgttaaaaatataattaccatatgacctggcaattatacttctgggtatataaccaaaagaaagggtcttgaagagctatttgtacacccatgttcatagcagtactattcactacagccaagaggtggaagcaacccaagtgtcccttgaccgatgaatggatgaacaaaatgtggtatatatccatacaatggaatattatttagccttaaaaaggaaagtagttctgatgcacactacaatgtggatgaacctcaaagacattatggtaagtgaaaaaagacaaatgtcataggattccacttatatgagctatctatgaatagtcaaattcatagaaacacaaagtagaatggtggttgcctacgtctgagttgaggggaaaatagggagttgttgcttaattggtataaaggtttgcaagatgaaaatgttccggagactggctgcacaataatgtgaattgtgacagtactgaattacatacttaaaaatgattaagatagtaaattttatattgtgaatatctgaccacaatttttaaaatgctaataaaaaccaaacaaaaccaaaaataaaaataaataaaatggaggagtgtaggagggaggtgggtgtaattataaaaattgttggcggggtgcggtggctcacacctgtaatcccaacactttgggaggctgaggcgggtggatcatgaggtcaggagattgagaccatcctgactaacacggtgaaaccccgtctctattaaaaatacaaaaaaaaaaaattgccaggcatggtggtggcaggcgcctgtagtcccagctacttgggaggctgaggcaggagaatggcatgaacctgggaggcggagcttgcagtgagccgagatcgcgcctgttccagcctgggcaacagagcgagactctgtctcaaaaaaataaaaataaaaaatatataaaaattgttggaactgttcagcatctcgactgcagtggtagatacatgaacctgcacaggtgacaaaattgtatagaactaaacatacacacgcacaaataagtacaaacaaaactggggaaataaattttaaaaaataggtagcatatgtcaatgtcaactatagttttgcaaaatgttaacattgggagaaactggactaagtccagaagtaccttctcagtatttcatacaattcggtgtgaatctataatcatctcgataagaaataaacacacacacacacacacacacacacaaggcctgtttttaaaaaacgatatatatgtgtgtgtactaatatataaggcagtagaggtaaatatccaaacaccagaggttaggtcataataaaaatgattcttttcatgtgcaggtgacaatatgcacactctataacaagcaatccctctggagaaactcatcagccaaacacactaatgtgacctatatgcaagtaactcctatggctgactgccttctagacacctcaccctgatcttctctataacggtctgatctttccaagaaacctgctctacccactgtctgccccaacacagttaaggccagaccttgagaggagaggccaacaatccttgcacaatggccaccccgcccccacgacttttctgacctcatctcctactaacccccaccatcgctggtcttcctcttttcttggactgtaccaggtgcgctcctatcttgggccttgtactgactcttccttgcctccttcaggtctttgctcaatgtcaccctcacattgaggcctactctaacaactttaatttaaaggattatttccccaatgtggcacaacaaatccccttagtcctgatctatttatttcctcgggaatttcttacatattaatttcctttattgtatgtctgtctactctgcccactagaatgtaaactccagtaagtagatcagctcttttgtctgttttattcactaattcatcctcaggacccagagctgtggcttggcacataacaggcacaacaataaaaacttgttgctgttgaatggctggagaaagctcatgacagaagcactacattcaaacaccttcagtatcactggtgtaacaatctttggaaggcaggctcctgatctactgctgtggggactcagatttcgccaactgcctgcaggtgggaagcacacccttggctggttcacagccatctgctgctgttatctctaccactttcgaccacaaaaacttatccccatcttctttagtaagcatgacacaatgacatctcataggtgtcagatgcctaagagattgaaaacatagcacaggaaggaagctgttgcaccatacaaccattgtgtgtgtgtgtgtgtgtgtgtgtgtgtgcacgcgccacaaactaaagtggaaaagtgtcacaggtatatcatttaggagaccttaatcacttctcctgaagcatctgccaacatataatcaacaaagttttgagattgggcgcagtggctcactcctgtaatcccagcactttgggaggccaaggcaggcagatcacttgctctgaggaattcgagaccactttaggcaacatggtgaaccccatctctacaaattaaaaacaaaaaacaaaaattacccagtagtggtggtgcaagcctgtagtctcagctactcaggaggctgaggtgggaggatctattgagctcgggaggtcgaggctgcagtgagccgtgatcacgccactgcactgcagcctgggcaacaaaaaaaactgtctcaaaaaaaaaaaaaaaaaaaccaaaccaaaacaaaaaacaaacaaacaaacaaaaccccaaaaaacaaaaaagttttgacgaaaggcatttctgtttcttaatacttctttcccccctcattttgcaaaacagaggtattccctaaaaagtatctgcacaggaggattgcttgagcccaggagctcaaggctgcagtgaactatggtcatgccactgtactccattctgagcgacaaagtaagaccttgtctttaaaaaaaaaagttatctgcaagggtacaatgtatattattcaggtgatggttgcactaaaagcccagacttcatcactaagcaatatatccatgtaacaaaactgcacttacatcccttaaatttaacaacaaaaagttatctgcaaaatgtactcctataaatctagtcccttccacctacttccattagaaaattaaaagctacatttccatagtgggaaaaatctgctagctcaacaataaccacaattaagaagacaacaaacctacaatactatttaagtgaaaaatgcacagcaggctgggcgcagtggctcacgcctgtaatcccagcactttgggaggtcgaggcgggtggatcacctgaggtcaggagttcaaaaccagcctggccaacatggtgaaaccccatctctactaaaaatacaaaaaatttattgggtgtggtggcaagtgcctgtaatcccagctaatcggaaggctgaggcaggagaatcgcttgaaccctggaggcagagattgcagtgagccgaggttgcaccattgcactccagcctgggcaacaaaagcgaaactccgtctcaaaaaaaaaaaaaaaaatgcacagcaacattttagctatgccagttatctgtacaatgcaaggtctgtaagggaggctacacaccaaagacattggatttgctatggtgactgatggggatttggttaaagtcttaaaaaaattcagacacttgtataatgtgcatacactaaatgcgtcttctaaaatcacaaaatcacccagttgtttttttccaaatggtttgaaagaccacattaaaagttttaacaatgtgttttcctttgtgcattttctaatttttcctaacttctttcacagtcttactgagctcagtagatagcaactctgcccttagactggaactcatccttctgttctctcttaactcttttgtgtgtgtgtgtgtatgagatggagtcttgctctgtcacccaggctggaccgcagtgatgcgacctcagctcactgcaacctcccactctgggtttcaagcaattctcctgcctcagcctcccgagttgctgggactacaggtacatgccaccacacctggctaatttttgtatttttagtagagacgcatttttgccatgttggccagactggtcttgaactcctaacctcaagtgatctgcctgccttggcctcccaaagtgctgggattacaggtgtgagccaccatgcccggcctgttctatcttatctcataccccatatttgaccctaccttcccaacatacccataacccaaactttcaggagagatgcaaatgttccttaactttatcagggaacaggttacaaagtacattaacttgtcaaaagtcaacacattatacatttaaggtctggacattttatttatacctgaaaagaatgtgtttatatatacacacacacacacacacacacatacacatatatatatatacatatatatattacatatacatataaacacatatatacatgtaatgtattacataaacacacacacacacagagtctcccccaccagctccaaccatttcttgccatcacagccatcaccatcctgatccagaccatctcttgcttggattactaccagtagttggcattataactggtctcctggctcctccctccctctggtcccccacaaccaatctagtctccacgtagcagtcagaaagatctctaaaactcacgtcagatcacagtagtcctctgctccccttgcagtgagaatcaaggccttctagtagcctactaggctctcccaatcagtctgctattcactctctggcctcctctctcacagcccttgccttgctccaaccacaatgacatctgtgctactgctcaaaccctccaggcaagttccagctcttctttctgcctggaatgctcttccctcagatggcaccttcctcatctccatgaggcctgcagcgaatgctgtggtatcatgcccaggtccctaccctccagggactaaagcacactcccatagctatctgtggagtgttggcagccccaacagctccctgtagtcttcctccaggtcagacctgccctcagtggaagcactcttttggcagggtcaggtctcctttccaaaagagcctatatccaggctgtggacacgggagtaaagggccctggtctcccaccccaatccacgacaattctgaagggcctccccagctacagaactcccagcagggctggctgcggctttctctgtgcttacatcatagcttgccttctccctctgtctggtgctgcttccttcactccttcaatggtgtggatcccgagagccctccccaataatcctgcatgcaaaaatctgcagctcagaatctgactcctgcaacaaggcctttgctcaaatgttaccttttcactcaggctttgccaaagcgtcccacttaaacccgtctatcccccgcctctgcctcagcattcctcatctctaagtctgctgtttctccaattcacaggatcttgtttgtgattccgctatgtgtctcaccaggaagctcccctcccacatctcctcttttccacttacacaggaaacccccagcagatcccatcccagtctcactggccaggatgcataacaggctgctcctcaagagcctggcatgctgcttggttcactgctgttttaagagctgaaaacatacacacactgactcacacacatgcatacacacacacacacacacacacacacacacacacacacacacatattttcagctcttaaaacagcagtgaatttatcaactgttttttccatgtgagaccttctgttagaggatgcagcagacctggagtctgctccaacgtaggtctatccctggacctcaaataaggcctgctgtcccttctgtctggtcttcaccacagtggcttttgccagggtagcctcccagggaattggcctaccctaggtttgttaatgcatcgaggcagacaatgcttttaggagcaacaaatgttaatctaaatgggttttctttttgccaggagtgttttaaaaccatttgctatctgtttcatccacttcctttcctaaaatggaaggctctagaagacagaatcatgtaaatgaactccttgggtaaggcttgggcagaatgtttcccctcatcattggaattgccagcagattccactagaaagagccagccaggatgaacaagaagtttatttgcagtacatcaactctaccagccaaggacaacagacactgttagctgcccatccatcagccactttccatcaccaacttccagcactcagcactccttcaacatttactgagtgactactatggtgtgtaccaagtaccattcctggccctgggaaaagggcatgagcaaagacaaagtctgttttccaggagcatatgctcccccagggaggtgtctaatagaactccagttttattcagatatccactctgcccgttatgtaagccagtaggcaacgatgattgatgcaagagagggcacatgacctagttggaccaatcagccaatggggaagacccaaagtccaaggctggggcacagacctctcccttctgcttctcactgaaaacattctcgataccccacaaccagagaactcttgaaaatcaaatgccagaaaaggctcaccaagcacatttcaagagaaacctaccaggttagaagccccaaggcactcagaatggctacagaagcagtcagaggacaagctccagggaccagactcctggtcccatgctgtaccacgtggtttctgaaagctgtccttctgaggaggaaatgggcctgaagctctccaggacggagtggccagcctcagcacaaagaccagtgcttagcaaattagaaagagtaagtctgggcttgggctggagtctaagtgtgactctcaacacatctccatcacatctagtggaatcttggtgccagggggtcacctcatctcactcagcctaagtttccatctgtgaactgtaatgctgcaagtcatagagaatttcgagggtaatcttctatcgtatataacaagtcctgagataggtcagcttcagggtgcattaatttagcaacttaaagagacgtgtccctctgtcttcctctcctgtcatcagtgtcggccctgttccaagctggcttttacacgcagacctagtaaagtccagcagaagagactagcctgtcaagcatctcctcttatttaattccctaggaggtcccagcagacgtcccctcctagtctcaagggccaaaatggcatcacatggctgttcctcaacaaatccttggcatttacccacacatcagcttagggctatcagcaggttggcctgcagaaggcagaccaaaaaaattggggttctgctaacaaggaacaaggcaggcaaccctacaatatttgcaacactccctttgtgctatttgacaatatgcacaatgttcacaatcccactcacttctaggtgttgttgctgactctggcaggatgataaaatgtgctttgcataaatttttggtccccagggctcattccatacctctggttcatgtgctagacacttctgcagtccataggcaaacaccccggatgaacagaacatgctagcaacctctggggaaagggaggggtcaagccagacacagagcatcctcttcctggtcaccgacaggacccaagatcagcacagtggaagcaggtctcctacttggcttcagtggtcaaggccagacgctcctcagaagtccctcccagctgtgtaactatgattctgctcataaagtgaaaatagttttcaaccacttcttagagtaaaacaaatgtttaagaaaatcccatttcctggccttcatccatattctttctgcagcatattaaagaaataaattcagagagaggctgggagcggtggctcacacctgtaataccagcactttgggaggccgaggcgggtggatcacctgaggtcaggagttcgagagcagccaggccaacgtggcgaaaatgtgtattaaaaatacaaaaacactaaataccgaatactaaaaatacaaaaattagccaggcgtggtggcatgtgcctgtaatcccagctactcgggaggctgaggtaggagaatcacttgaacccgggaggtggaggttgcagtgagctgagaccatgccactgcactccagcctggcctgggtaacagagcgagactctgtctcaaaataaataaagaaaatatataagtaaataaatacattcagagtggcccaaatctacagtcacctgcctacatggccaagtcccattaattctacctctaccctgtctttagtgcctctctatttctcacctccatcacctgtgatctccctgtctccctgagcatctcaccaagactagaaattcctaactcctctagggcctgcctaagacacaggttgggtgtttcatccagcttcctcagaagcctcaatgttctcctctctcccctaaccccaagaaggaagttcaagctgctggcaaggctctgcctcccagccccattctccctcttgccctgtttagcctccctcctaacatgttctatgtctttccctaaatgctttcaccctctgggccttttctcctgatggtctcatgtgctgtagcgccttctctgccatcacaattctagtcacgtcaaggttcagtccaaggacacatccacaaacccgactctgctggtgaagtgcccttcctccttgggctatcacgcttattcctctagctcctgtttcccctgccctgcattctagaatacggtttgtatgtcaatctctctcatctatcttccacacagctttctgttcagagagagagccttatttacctctggtccccacagaactcttaccagaaaggttcaatgtttgttgcataaatcagtgaaaaatccacagcaaaatctcacccagttttcttctgactcttcagatgtactctggttattttcctaaatcaacctactgtcttcaggcataagtcaggagagaaattgctgagagaatttgcattttctgagctaccacatggagcaggtgaggcaagaattactgacttcatgaacagattaggaagagatggaaaaactttttatgtcacatatttagtaagcagcagggcacagagactccagagcaggatatctgattccaaaaacagaagacaaaattcttgtcctcaagaaacttacagtctagtcggaactgtaagacaaatacaccaaaaggcaaataacttattcagagcggggtttctcacccttagcactattgatatttggggctagataattctccatgagtgggctgtcctgcatgctatacgatgtttaacagatttgtcccctacccacttgataccagtagcacgtaccctgcccaaccctgttgtgacaaccacaaatgtctctagacattgccctgtagaaccactgatctaaagcaactgccatgtttatctctcaaccactgcaatcatataacctcaccattaggatcctttccctgccaattctcagacataggtctgcagtgccctccggcagcaggctggaccttacccacccactcctaactttatcattatatgattctgcctacattttcccttcaagctgaattatttaattttcatgctgatgtctcagtaggacagcttcaaatccttttcagaatgacacaaggtaggggtaaaaataatccaatcgcaggacaggagaaaatacacaccataaggccatgtgattaccagcaaattaccctgttcttgaaaatttcccaaatcccttttcataacactgccatcaaagtgtgaaccaaaggccaaaggtggacaagagctctttcagtcctggccctcttggttagaactggcttcaccaaagagctgagcataagcgctgtctgcccaggcatgagaattccagaaaaaactcaggagcaaaggcccagagttgggaagagccatgaatctcaacgagattttctaaacatacaaactccatatttctacaaactttaaaaccagaaacctagttgtttttactttctgaccttaacctaacttagaaataaagcttattttggtcaattctaaaataaaatatatagagaatactgtatccaagaacacgaagtaaaatgtgtatgtatgaacaataactgacacatcttctatataaatgatagctattatatttcaatttaacaatcttttatatttggtcccaggataaaatggaagaggtaagtcttattttaccaaggcccagaagtagagttataagtccaagaatttacagctagtaaatgatgcagttttgaacccagtctgattccacattcaaggctcatttcactacaacgtgacaacttcaagattaacttattgataaccttagacaagtgcttctcaattgggggtgattttggctaccaatggacattggcaatgactggagatatttttggttgatacaactagaagttgtatcaacttactctaagaaggtgtttgtgaagtgctactggcatctggtgggtagaggccaaggatactagaaacattctataacatagatgacaatcacacaattttatggcccaaaatgtcaacctgctgaagttgggaaaccctaccttagaggtgtctctattatcagccaagaaaatgaagaccaaagtacacccacatttcaataaatacttcttctcctgttctagctaccctctccactttgaatggattccctgccacaccagagaaaaatgctgagctgtctgctacttccccctttagactctcgaaaaacagaaaaagtatgttcatgctgggtgcagtggctcacgcctgtagtcccagctactcaggatgctgaggcaggaagatcccttgagcccaggtatttgagtctagcctgggcaacactgcaagatcccatttctattaaaaaaaaaagttatgtttgtgcttcacaaaattggagacatgaatatagaacaaggaagccagaaagtgcaatgatggctttacaaaagcaagcacaattttactggccactacccacccctcaggcttccggctgagcagcccctgctcccagcagccaccaatactcctacagtatttaaaggcctgctcggtagtgattcagaccagcatcatctcctccagggcagtggtaatttacctcttgacagtccttctgaacattccatgagattttaaaagaaaggaaatttaacaaagaacaagtttaaaagaagttaaatcccatcctgccagagttgccatatctttttttttttttttttttttttttgagatggagtctcactgtcatcaggctggagtgcagtggcgcgatctcggctcactgcaacctctacctcccgggctcaagcgattctcctgtctcagcctcccgagtagttgggactacaggtgcgtaccaccacgcccagctaatttttgtatttttagtagagacggggtttcaccatgttggccaggatggtctcgatctcttgacctcgtgatccacctgcctcagcctcccaaagtgctgggattacaggcatgtgccaccgtgcccagcctctttttattattacttattatctcagatttctaaagcacttaacagtttggggagcatttttatatctacgctcccaactgagtatcacaagcatactatgaagtggttagagtagatattatcatgctccattctagggctgtagagaggccctcagcaataagggccactgttgtgcttgctctgccaggctgatgcacttggctgctgatctgagtgtagtctcttattcatttgtacctagttcgtcacttaagcatcttgacttacttatgtttacatagcataaaacttttggcctacaaaggagcttatcaaaaaggaacaagttatatgacagtagaagagaggctggagaagggtaggctattcacaaaaactgatttaggtaaagcattttaaaataaaaattctatcagaccttcacacagtaaactagttcataataacatttttcctttcctaatcacaagcatcataattcataattacaatatttgtccagttctccagggaaagatctgcacagtacacatcaggaaatgctcttggagatcaacaggagaaatgaaactaaaactcaaggcttcggctttcatgcacagtaaacctaacttcatcttgataaattatgaaaacctcagctttcttacctgttttagccaatatttatcacatacccatcatgtggaagaggttgttcaatgcagtagggcatacagaagggactgaggcagtccctaccctgggggcatatggaaagtaccctcacaccttccatgccaggcaaaacacacagacagtgatacagcacatctaccggggtaactcaggatgaacagtttcaaaagaaacacgtgaacctagtccctgaaaaatgggaaagatgtcacacaagatggaaggagagagaggtggcaggaggagaacacacacatgatcagttcagtttagttgtggtagtagagagcatcctgggaccaaattcaaaacgaaaaagccacatgttaaaatatctattctcgctcctaaagaaaacggtagcaccctgtagtcgcactgcaaagtagaaatgaggaacaagacagcatcagggtgaccctttgcctgtcaacagtcagacaggccagaatcaggccctgggctggaggagtctccctgggttgatttctgtgctacagtgctgtcagcagagtggggtgggggagggggaggcgcgcttttttcatctacccggggagcaaacaccaactcctgcagcagttctgccaacaaggcagaactatgacgaaactgattaccactagcctctctgtatcagagtcaagatatggggtggatgagtccgttccccaagggtgtgctttggagccactgccacagagctaagaagcccctctgctagaacacacctgtgccctatctgcccaaccctagttcaccctgatgtcccagctcagcattaatcgtggatccttcgcgggggcccggggcccccaaaccctcctatttagggaccacaattccccaactgggggcactgtccccagatccagaggggcagtaacagtccctcttgcagatttcggatcttcatcctgccactgaaaggccacaagggggatttcatcccggtttcaccttcaggaccgtctgagcacttctcgggcgatgcagaccagtggaaggcactggctggcaccaaggcccgctcctgggagccaggccgcggcccctccaaggaccacaggtgggcagcggaagactcagagcaagagccaggggcgaagatggccctcgctgcggtcaacccggagcacgtgctggggctcaccagcctctccgcgctgaggacaaagtccgctcccgccggcttcttggcttgggcaccgggtaccgggcgtcaggggcgagacaggcaggacttgcgcgcgccccgactcgactccagaccccgacccgactccgggctcggcctcccgcgacccctgcgcgcactcaccattgtggttgacccaggtcggcttcaggagcttcattgttcggccgccgccgccgccgggctgaggcgagcgccgggtccctcagcgcgcccgggccatggagccaccgccgccgcttcctcccgcgccacccgccctccggccgccgcccgccccgcgccctcagggccgccgcgccatcgccggcccgcgcccccctccgccgccacagccgccacccgcgctcggccgccgccgccgccaccacagccgcatc

SEQ ID NO: 1054 - DNA, 710 bp, Homo sapiens
ctttgtgccctgactcactaattccagggtaacaggaaaaggctcattaaacgtcccgttacacacagctctaataaaaacagcaataataacatcaaaacactcacatagtgcttgccaggcaccagtctctttctctacttatgttaactcatttcctcttcacaacaacccaccccattaagcaggatcagtaacccctttgcacagctgaggaaactgagacatagaggaggtaaactgcccaaggtcacagggacagagagccagagagctgcaatccaatcgagggagtttggctggagtccacgctgcgctgctttccacataggagaggcagagaaaagctgcacctgcaagagcgatggtttcggctgcgtatttggaataacgaagtcagcggtcaggagcaaggagaaggcacacatctcgggcctcatttctgtccccgagcgctcccccacactgcgagatcatggcggtggaggggagtcccgcatcctgacccccggccgccgcgcactggggggccctcaacctctgggttacttgggggcacgcagtagccacccacggggcagaaaagacgggggcggtcaactttctccactccagccgcctggggtcccgccatccctcagccaggacgcttggcagccgcctctaggctaggtggccacgagttgcgtgcgagagcgagggctgcgcat

SEQ ID NO: 1055 - DNA, 85 bp, Homo sapiens
gtgagcagtctccaccacctcccctgcaaacgtccagtggtgcagaggtaatggacgttggctctggtggtgatggacagtccga

SEQ ID NO: 1056 - DNA, 82 bp, Homo sapiens
agggggcgagggattggagagaaaggcagttcctgatggtcccctccccaggggctggctttcctctggtccttccctccca

SEQ ID NO: 1057 - DNA, 88 bp, Homo sapiens
taagctgagtgcattgtgatttccaataattgaggcagtggttctaaaagctgtctacattaatgaaaagagcaatgtggccagcttg

SEQ ID NO: 1058 - DNA, 3561 bp, Homo sapiens
ggactgtggaggggcgcacgcccggaagcggcgagggtagccatgacggcctccgtgctgcgaagtatctcgctagccctgcgcccgactagcgggtgagtgcggacgctggccggatagcggagtgcccagggcgcgtgcggggtcttcgcgactgtccgccaggactcgcctgtgctccctgctcgcctcccagtccacgaatatctcagggatgagccatctggtcgtgactcttatgcatgaaaatctgagcaccctggcgagcagcggtcctgcttaagtcctctgtggtctgaacgaaagattttgaaaaaccttccacgttgaccttgctgtcatatcaagtagttagaagtgccccgggtttgggagcattgcaattttttattttcctgtgaagtgggagagaatcagatatttatttatttatttgagacagagtctcgctctgtcgcccaggctggagtgcagtggcgcgatttcggctcactgcaacctctgcctcccgggttcaagcagttctgccccggcctcccgagtagctcggattacaggcgcccaacaccacgcccggctaatttttgtatttttagtagagacggggtttcaccatgttggccaggctggtcttgaactcctgacctcgcgatccacccgcctcggcctcccaaagtgctgggattacagacgtgagcaaccgcgcctagcctggagaagcagatatttatacatactcttgtatctttcaggcttctgggaacttggcagacgcagcttagagagactcaccagcgagcgtcattgttgtctttctgggaactcattcccatgaggtaaaactcaatcgagggcctgacctctgggggtaaaggtgtcagtctatgtgtagagaacaaagcaagaatgctggatgtgtggtttgcaaaattaacagcctacaaagtttctcagttaaatttaggccgatgcttttctgtttttccaacattttccaaaccatagattgttgtttgtaatttttaaaatttgagcagtttctcaagaagtaagtattctccttgaagggattcttgtgtgttttaaaggacacagcttaagtttctgtttctccatgacccttcctcttccctgcccattcggaggccctggagagtgtggggaagatgcaagtattaaaggtatttccatctggcactctcgactctttgtagatacttgattcagtcaatcttgatagtaaaggatttgatttttcttttttttttgagatggagtctcactgtgtcacccaggctggagtgcagtggtgtgacctcggatcactgcaaccttcgcctcctgggttaaactaattctcctgcctcagcctcccaagtagctgggattacaggcgcccactaccacgcccggctaatttttgtgtttttagtagagacggggtttcaccatgttggatgttggtcaggctggtctcgaactcctgatctcaggtgatccacccacctcagcacccaaagtgctgggattacaggcctgagccaccgcacccagtccacaaatcaattttaatagtaataagcttctaatctaacagtttggtattttcacttttgagtgtaatcccaaggcacacctgaatcccagcaataaagaggaacacttcccgattttataccctgatgcctcttgttgcttttgtacttttttttttttttttttttttttgagacagagtctcgctctgttacccaagctggagtgcagtggcgcgatcttgtcctactgcaacctccgcctcccaggctcaagtgattctcctgcctcagcttcccgagaagctgggattacaggtgcgcaccaccacacccagctaatttttgtatttttagtagagacagggtttcgccatgttgaccaggctggtctcgaactcctgaccttgggcaatctgcccgcctttgcctcccaaagtgctgggattacaggcctgagccactgcacccggctgcttttgtactatttcttgtaattgatggcacctacacagttctcacaagtactgtggggtggagtacctcctcaccacgctgagctcatgagttagtcatgcacagctccttcccccagtggagaggtcagtatggggtacttaccatcttgtctctcagtaggttcatgagaccaaagaggaaaatgtttaatatttgctttatctattagatcagaacctcttcgaaaaaagaagaaggtagatcctaaaaaagaccaagaagcaaaggagcgcttgaaaaggaagatccgaaaactggaaaaggctactcaagagctaattcctattgaagattttattacccctctaaagttcttggataaagcaaggtaaggatccttctctagggatgaagtcctcaggacaaaggagtaatatcaacttcaggtagttgtgtctgtagttcacacctgtgatagtcattggtcagtaggcttgagctgacttggccctaatgagtccttgctccttttggaagcaggagaaagcatccttgggtggtactcttgaatggctctgggtgggaaagaacctaagacatctaataatccagatgcttaagcactgctctggagttcatgttgttgctgtcatgcatgaggagtcttggctgtttctgatcccttgggcctggagtctgaagccctcgcctcatcctaacagtagaaaacccttggcctcctgttttatcatgcagatatctttggttggtatttgttgggattctactgtgtgcagggttaacagctcctgctgccgttttgtaagcagtgtgcaccatctataaaggggcaggtgttaaaagtcttctctcacccaagggagtatttgcttgggcagaggaagtgctaccagtctcctcagatcatctgttcttttgacagagagcaaatgaccttggttccaagcatcagttgcagctgcagccacattcaacattccatttcttaatttgtcccaaacttgttttatctcctaagtcctgtctgtgtctggcaatgggaatacttgtgtcagttgcagtcacagacttacatgccagtgagattggtaacccttagcttctttgcagagagcggcctcaggtggagctcacctttgaggagactgagaggagagctctgcttctgaagaagtggtccttgtacaagcagcaagagcgtaagatggagagggacaccatcagggctatgctagaagcccagcaggaagctctggaggaactgcaactggaatccccgaagctccatgctgaggccatcaagcgggatcctaacctgttcccctttgagaaggaagggccacattacacaccaccgatccctaactaccaaccccctgaaggcaggtacaatgacatcaccaaggtgtacacacaagtggagtttaagagatagacttgcaggctgctatccttaacatgctgcccctgagagtaggaatgaccagggttcaagtctgctttccacagaatcaggcatgctgttaataaatactggtttaatcaa

SEQ ID NO: 1059 - DNA, 26977 bp, Homo sapiens
ttccaacacagcactattttgggtttttattttgttgatgttggttaaatcttatctctttttttatacacaatacttcatgtacctatgaaataagacaggtagggaatatgtccagtgcaaacagaggactcacacctgtgcatagacagcaccatccattgattgtcgctgcagtccatggcgttaccaaggctgcgccacccacgtgctgccccaggaggcgctaccaggttctttgggccacaggcctctcctccactgcatgtggcggcagggcagggaggtcgcagggctccatgattgtgggacagctttgagggcacatggggcagaggccctcgaaggtcccctcctcagtaggggatgtcattctgatagtactggatcatgtcgtaggtccggctcctgaaaggccaaggaagagtgaagggagattcgaggagccagcagggtctggggtccctccccacagggagccctacctgtccaatcagccccttatggctgcccagcacctgaaggtacaaatgtcccaggcgtgccctcccccacccagtgaccacatctcctgctccaacccgggggactccgaggccacctcatgctcctcagccaaaccgcttccatccgtgggagccactgctctgccccatgggactcgggccccttggctcgtcctggccagatgcctccaaggggtctgtacgctctcctcgcacctctggagagccccttctcgccctgccccagcccctcttgaggtcctggccgcctggcttctctgcttcctatcagcaagagctccttccgtgcccagcctccacagtgcccttgttagggtgccggacccgggcgccacctgggggcaggtctcagcttcctctcacgctcctccggcagttccccatgcagatggccacacctgggcccctcctcctagtctgtgaatgtggtctgtcccatggcacagccttgggctcccacatgcccctcagggccttaccaaccccacatgtttaagtgctgcccccttcggggatggctcacttgctgggatcgccatcctccctttgttcaggccggacccctcaaagccacctctgactcccacagcagggagcctgtcagcccggtgctctgccttcagaccctgagccagccctccccagggccccctgcacccatctcctcccaccacagtagtgaccagcagcccggcctgcacctccagtcactgcccacgaagcagcccgaggcaggcgcagggaaggagtgggctctgactcctcagccctcctgggaggagggaggcctgacaccacactcagttctaatactcctggccttgtgtccctattgctccttcggcctcacgagccctgcccaggtgggcccggcctctgccaagtgttcccctcggcacaccacagccccctaaaccagcaccccactgctcctcaagagctcctgtcaagacttgggtcttcatgagaggggcggcttggggacagcagaatcctcatcgcctggtgcaggcaaggccctgcaggtgcccagtggccaccgaggcagtgggagaaggcaggggggcggggcactcacctgttgctgaggaagcagctctggatgaccttcatgatgaaatttgcagcctcgcgctcagtcatgttggggctaaacctgtgcctgggggagaggctgtgtcagggctgccatgggcagggccgtgctggctccctggcccagtgggaggagggtcttccatggggacggacttcagctgagagccacgccctggaaatgtacctttggggtccacatgttggaagatggggtgctgtgaaggccacgcctggcctatcatgggccctgtccccttcccagcatcacctgagtggccccatggcattaggggactaagcattggggagctaagctactgcagccccagaccttagggtggaggtgggttgggcgtagcatccttgacataaagaggcccctgggtgggtctctggtgtggccggcacaagcaggggcccctcacagttgtggtctaggggcagagcctcacccaagaaccctgtctgctctgaggttccaaggagatgacaaccacagtgacaattacatgaaaggtacctatcttggatggagcctcagctaatggacaactgtcccccagatggcctgcgtgtccaccaaggaacctacttcaagagcttgattgtctggccgcgaaaacagggcaggcccgtgtccaacatgagagtgaccagggagacgaccgcgtccatgtagggcctggggagagataggagggagcggtgggctgaggccagcctaggtggtggccctgcctgtagtcctgtggactggctgatgccaacagcctcaggtgtgggctcctgccacccacctcgcctgccacatcttgcacatccccgaggcaactttcgatctgctgcacttggtaacccataccgcccaggcaagggctgcccacacgcactctggacaggctgagtgtcctgccctgtcccccacataaggctgccggccatggcttctgcacttgggtgggatgcagacacgctgacctgcctttctctgcagggcagtggggatgaacccaggttggactgtggccttggccaagtgacctgtatatgaaactgggacaaagcccatctttggcacgtagcctgtggggtggcaggtgctcaggctttggtgacagggtggatgggatgcccagaaagggagagcccatggctgaaggcgtgggcaggatcgtggggaaggtggttggaattagatgtccagagcaagaatttactggcacaggtgggcagacagaggtgaccaaaggacaggtgtaggtcagcaggtggctgctagcacctacctcactctctggaaccggattcccttcatcctaaaggggatctcagaacgttccacacaccccctccgcctccaccctggccctcacccaggctcaccgcacagccaggtagcctcggacacacatctccatgaaccacttgaagggtgtggcctccatcttgccccccatgatcatcaccatctcatccgtcagcttgatgtcgggttcccagccgagattgccgcccggcgagctttcaaacatgaagccaaagtctgcaaaaccccaaagagctgcctgtgactgggtaggagccagggcgggcaaggacaagtggtctgttttgaggagtggaaaaggactgcaacaggagcaccccctccacccccaacaggcaggttgtgttttcttggagacagtgatggggtgggtggtggggcagcaggcagagaaagagaagggaggaagtggaggaaggagccaagctggggcactgaacctggaccagccccactccgcccagctccagcttctgactcagagcaatggcggctctcgccctagctccctggggccggggccaggcaccctctacagcagaacagcttggtggccgacagttcggacctcagagctggaccctgacactcctggcagggtggtcctgggcattctcctctctgtggggtggggatccctatccacccctgggtgccaggggtgaagggagaggagggtggcgctgtggctggctgaccgatgtggatgatatgacccttcttgtccagcataatgttgccgttgtgtctgtccttgatctgcagcaggaacagcaggaggctgtaggcggccatgcttcggatgaagttgtagcgggcctgtgcagagagcgccctgggctcaaaaaggccctggggcctgtgggcattctccctggtcccacacccaggatccctgggcctgtgggcactctccctggctctgtacccccactgtggaagcagagcccgaatcagcaagccagtcttcggtagcaggagtgacaggggctctctgtggaagtgggcgtgcaggcacttcctcccacactcagaacttaactttcttctaaggagtccaacccagccctacattcttttgactcccaaagtggcttacagatgccctggtgttttttttttaaatggagtctcgctctgtcgccaggctggagtgcagtggcatgatcttggctcactgcaacctctgcctcctgggttcaagagattctcctgcctcagcctcccgagtagctgggactacaggtgcccaccaccatgcccagttaatttttttacttttagtagagatggggtttcaccatgttggtcaggatggtctcgatctcttgacctcatgatctgcccatcttggcctcccaaagtgctggcattacaggcgtgagcactgcgcccggccaggtgccctggtttttttgtgtttttttttttttgagatggagtctcactctgttgcccaggctggagtgcagtggcgcaatcttggctcacagcaacctctgcctcctgggttcaagcgattctcctgcctcagcctcctgagtagctgggactgcaggcgcgtgccactatgcccagctaatttttgtatttttagtagagacagggttcaccattttggccaggatggttttgatctcttgacctcgtgatctgcccgcctcggcctcccaaagtgctaggattacaggtgtgagccaccgtgcccggcccaggtgccctggttttaacccttaacaaaggatgactgaggagagcagggtgtgggtggaggctgggtatgggtggctggggtggggtggagcacacacgacctcccccggcctgtggccaccctggctacctgctggaaggccagagtggactcatccccgtactggcgtgtgaagtagtcgtacatgccgaagtctgtctggcggcccagctggtcccgggaggtgcagtcggggatgcactcgatcaccccgcactaggaggaaaggccagttctgaggcccgctgggtgcgaggtgcccagggctgccctactggctccactcagggaacttaccccaggggcagtggccaccacgcggtagggaaaaacaaagaggtccaggccgaccagctggaagatgttcttgaagaggtcgatgatctgcagggccagcatgtcctgggaagccgggaggcgcaggatgcggtcagttggcgtccttgcaccccagcagctcttctggctcatgcagggcaaaagccaagcacccagagatggagtgaggtggggagaccacagccgagcaagagtctggaaggccttcctttctgaccaccgggggctggactcaggctgctgggaccaccaggccctgggctgagcatgaggctgagctgtctggtggggtgtgtgagataaggcacccaacccctggacagttccctcaggtgggcactggcatggcggggacagtgggaaaggggctggaaggagaggcctctgggttttgcagaagccctaatttaccccgtggcacctgaaccatataagagaaggaaaagattcacatttctgcatatgagattggactctggcgggcctggagccttggggagcagcaagcccagtccccaagcctactcgaggcctgaccctgcttacctgccggcagtcgtctcccaccttgaagatggctgcctgccaggagatcttctggccgtcggcctcctgcgtgctgcactcatcctcggagtctgagcggcaccgcagacctgcccgcagggagagaggccgctgttagcctgtaggcagtgagaagccctctgagggggccagggatgagtcctctcacatgcctgaaaggaaccccagcaatcttggggatcacttcttcaaaaccccaaggaggccaaggaggagcccagcagggcccaaggaaagccttggaacagcaggtggaatccagggttggagtctaagaacatttaggcttaaatggaactaaaaacagagccccatttcatctgcagtgaagacccaggtgtgcctgggtcagtgttgggtgctgtgagctagggggcaggaggaatgtgtctgtacactggggtcctgggagggctcggggccagcgtgcagacatggccatgggaggcaggtccctgcaaggggtggcagccccctctccacagctggccacaccgtctgtactgggttgaagagtgtctccctaaaattcatgttcaccccaaaccttaaaatgtgtccttatttggaaacagggtctttgcagatgtaattaggttaagacaaggtcacagtggattaggacagtccctaatccaatgactgatgtccttcaagggagatcatcatgtgaagagggaggcggagatgggagtggagcatctgcaggccaaggagtgccaggactgctggcaacaccaccagaagctgaggaggcaaggtgtgacctgcccagagccttcagagggggcacggccctgatgatggactccagcctccagaactgagatcgtccgtacggtagccctgggaaactaacaccccccaacagccccgggcccctcagcctcaggaaggagcctgctggagcatgccagctgactcacggcagacagacctctggggtggcacatctgtcagtgcatttgagctccctgccatcccccaatgagggatctgactgagtgagggcagacagatggacagacatcatcttttatggagagctatactaaatttaacacatgccagaagaaactggcattagcaaggaaaagcactgagctcccaaacaaaatcagggttctttactgaccttctttttcaagttcactaactccacatcgcttcaccttgaacttggccagatatggggcttttgcagcactgaaaacaacaaaaagaatgtggcacccatgatgcagccgagaaaaacttcgcacgcggacgcgtggaagtgggggatgggtagggtgaggcgcccacctctgcatcggggtcccagacttgtagtcgatgtccagcacaatggcctcagggttgctgggcaggtagcagcctgtgcagggacagaggcagtcacagggagtgcatgtgtcaccacaggtgagccagagtcagtttccaacacggatgttacatgcgtgtccaccctgcaggcacaccccgcccctgtggaggggcctctggtccttgtccagggcaccactaacttattattccatggccgctaagggtccgtcctccttgactcttcgactcttccagccatcaaccaaataagtctgcaccttctgggaaatgctcttcctggaggagcactgagccccatcctcacggatacagccctactgcttctgggggtgcgtgtgaggcctgtcctgcctccacctgcctgagcaaccctctgaacagccctccattcttggagtccttttttttttttttggatagagtctcactctgtcacccaggctggagtgcagtggtgcgatcttggctcactgcaacctccgcctcccaggttcaagcaattcttctgcctcagcctcctgagtagctgggattataggcgcctgtcaccatgcctggctaatttttgtatttttagtagagatggggtttcaccatgttggccaggctggtctcaaactcctgacctcaagtgatccacctgtcttggcctcccaagtgctgggattacaggtgtgagccactgcgcctggccttccttacccatttgaatactactctctcaaaaggcttacttaaatgtcactatgtccatgaactgtccttggttctcccagcctttaggacttttgtctaagacgtttctttttttctttttgagacggagtcctactctgtcgcccaggctggagtgcagtggctcggtctcagctcactgcaacctacgcctcccgggttcaagcgattctcctgcctcagcctcccgagtagctggaattacaggcgcctgccaccgcgcctggctaatttgtgtacttttagttgagacggggtttcaccaagttggccaggctggtctggaactccttacctgaggtgatccacccgccttggcctcccaaagtgctgggattaaggcatgagccaccgcgcccggccaacattgtttctttatgtttattttatatctctgtgagttcaagcttcttcagctcagggaccatgtcttactcatctttttaacagctacaatacctaatgtcatgccttttcttttcttgtttttgcttttttgagatagagtctcactctgtcacccaggctggagtgcagtggtgcaatctcggctcactgcaacctccacctcctgggttcaagtgattcttgttctcagcctcccaagtagctgggattacaggcacgcgccaccatgcctggttagttttttttttttgagaccaagtcttgcactgtcatccaggctggagcgcagtggcgcaatcttggcttactgcaagctctgcctcccgggttcacgccattctcctgcctcagcctcccgagtagctgggactacaggcgcccgccaccacacccggctgattttttgtatttttggtagagacggggtttcaccgtgttagccaggatggtcttgatctcctgacctcaggtgatccacctgccttggcctcccaaagtgctgggattacaggcatgagccaccgcacccggcccaggctcccctttctcagtgagtgctcagtaaatgtgtgaaataagaggacaagggaaagcctgtttctggccaaggaactgccagtccccaagggggatgtgtgctccttgagccctgagaggtgggctttgaggggagccaagcttggccttgctgtggggtacagggagaggggggcatgccatctcctcctcttcctcacctgcccttcttcctgctccaggctgtggctcacactcaggcccctctgtgctctcctgctagagccctgctggcttccctgacctctggggcaagactcagccaacacaatctagagccaggggctggggacttctgtgcatgccccctgcagtacaatgcttccagctctttttgcccctccccagcagttgtggccttcccgatgcgggaacagaggccctgcatacatgtcctgccctctctgggaagccgtgctgttgtgtgagctcaacacaatgtgttgggaagaaatggttaaaccggggtcctgcagggcactccacagctgagaccagccgctgtgaacatctgcacaggacagagtttggaagacaagtttgtgccaatagttagaaatgcagagagaggccgggcacagtggctcatgcctgtaatcctagcactttgggaggccgaggcgggcagatcacaaggtcaggagattgaggccatcctggctaacacggtgaaactctgactccactaaaaatacaaaaaaattagccgggtgtggtggcgggtgcctgcagtcccagctactcgggaggctgaggcgacacagcgaaactccatctcaaaaaaacaacaacaaaaaaagaaatggagagagagctgcccagtgaagtctggatttccatcttctcttgaaaagctcagcttgaattcccatgtggccacagccacaggcacccaggagcgacttcccatggaggcggtgggggggtggtgctgatgggtcccagcacacctgagccgtcccacactgggcccgccatcccctcgtctgtgtgacctgctcctgtaatgctggagcctaggaaccctcttctagagtaacagctactgaggtcactgtcagcctccagaaaaacagcaggcagcaaggaagatgaagggcacccactgacgagcagctcccgctcactagcggcagattctggggaggggctggggtcctggggcaccaggcaccgtgggcccaagcaggtgtggggctggccaagccactgtgtccacatcctgcagtgcctggagagggcagcagccttcacgccccgccgcccgcctgcaggaagaggttggtctgagcctccagaagccacctgctcacccggctgcaccttcacttcagacagggccgacagacaagccttctttctctcgtcgcctttagggtagggcctgagaaacaggaaagaaattcttgctttgtctcctggaggaactggctgctgggggacagcccagggcccctcctgcctggattgccctctctgtccctctcttcccggctctagctgctcctagcgcagccaggcaccactggcagcgattcttgccctgcattcctcatggagaatccccgacagccccggaagggctgttttctggcaggctctgcccctgctgtgtgcgggggtgtgtggctgggggtggtgggggtaataatgcctgccacctgctgccacccaggaaacgctagctcccgtccttcatctcgtgggttagaagctgccagcactgctattctcagcacccagcccagaaaaggacctcaaagtgaccaaggtcagagcagtgtaagcactggagacagcccagccagcgtgcccagcattgatgactccagggtttcatcccttatgaatgcacaaagccatcaacatccaaggatggtgtcaggtccacatgaatggaaggtctaggaaaacgatgacaggacctgcaaaggcagtctggttttcctgacaccatgaggatcgatccttcaaagtgtggagagggcagggtggcctcaaattgtggagccatgtgctaaattccacaaacctcaggaatgaaactaagctgtgtttcctgaaactggcgtggccgtgcattctgccataccttcaagagccctggctcaccccaagcagtgcttccccacccaccctggctgtccatcagaaccaccagcggccccgctgctagagactctcattcatctggttggggccaggcacgggtatttttaaagcttcccaggcaattctgttaagctgcagggactggaaggagatcccagaaggtggtttctgaagcactgcacttacttgatgatagccgacacgttggtgatcttgttaaagaaatcaaactcccgctggtaaaagtccttcgctgggccggacaaggagcctgtgatctcctctaccaactgatccaggaggtcgccgatgtcagctgccaaggaagcaaagaggcttaagtctctgtggctgtggcagaggcccctcaggaataccagccctgtttcccaggccccagactggcagtgcccagagtatgctctgcaggcttggtgagaccataacagctgccgtgtgccccttttgctgtgttgacacagctgacgctgctgggaagctaagctggtgcctaagcggagctcaaggcaggggccaagcgcacaagtggacgtggaatcctcactgctgcacacgctacacacgcaggaagaaaaaagcccgtgtcatttatgaatgtcacagggcatagaatcctcactgctgcacacgcagggagaaaaaagcccgtgtcatttatgaatgtcacaggtgaagcaatgaaaactaattcttattaaactctaccctgaatacatgtctttttttttttttaatagaggcacacagtgggcggggctctatattaaatagtgcctctcactattcaaatcccaggctgaatttaaattcctgggctcaagagatcctcctgtctcagtcacctgagttgctgggactacagctagtaggtgggactacaggtgcgcatcaccacatctggcttttaaagtatcctttgtgatgaaatgggatgtgcacgaagcactcttgccgcatctaaggcaggcgctgtcctgagaagcacctggagcttgtctgattttggagcctggactaacctttttcacagacctttgtttttacttgaagaaatgactgacagacaacatatagctattcagacttagggatgtggcagatgttttcctgaaaatgaacaaaaaataaatcttccactcaaaggaactgaaacatttttttggaaaacttggatctgctgctgtgagctcaacagcttcccttaaaaactctttctgggccgggcgtggtggctcatgcctgtaatctcagcactttgggaggccgacgtgagtggaccacaaggtcaggaaattgagaccatcctggctaacatggtgaaacaccgtctctactgaaaatacaaaaaaattagcaggcgtggtggcaggcgcctgtagtcccagctactcgggaggctgaggcaggagaatggcgtgaacctgggaggcggagcttgcagtgagccgagatcgtgccactgcactccagcctgggcgactaatcaagactctgtctcaaaaaaaaaaaaaaaaaaaaaaaaaaccctttctggtaagactggcagatgtgaacaaatatgatttttccacactgtacaaagaaatgcatcaacctttgaaagatgtgcataactcactggcctatattttacaaatgcccaccgtttgatgttataaaagcttttgtgggtccaggtgcgacgtagacagacttgaacaaaacacagcatgagaagtttactgccaagtttaagatgccacactgcaattaaccttttttttggcgatcctcctgccttggcctcccaaagtgttgggattacaagcatgagccaccatgcccagactgcaagtaatcattaagaagctaggctgagctacaaaaaattaaaaattagccagtcgtggtggcgtgcacctatagtctcagctacttgggaggatgaggcaggaggatcgcttaagcccaggtggtcaaggctgcagtgagccgtgattgcgccactgcattcctgcctgggagagggaccctgcctctaaaaaaataaaacaaaagctaccacttctcaagtgtggtgcagtatcaaaaagaatctccacaatgacctgagagactactaacatacaacttcctttttcaactacattcacttcaactgaaacaacactgcaacagatcaactgcagaagtggaacgagaatgagaatccagccgtcttctacaaggaaatgccactcttttggctcattttttagttttttggggaaagttattttcccaaaaagatgttatttatattaacatgtaatgaatgggcttacattttctgaaattctgtcttaatctctaatactcgttaacactgacagctaatgctcacattaaacagcgctctttgaggacctcaataaacatttctgacagtgcaggggtcctgaggctgtgctatttgggaaccgctgccctgggctgacggccccttcctcacatgcagtcacagttgtgttgaccatggagactctgcagaagcagccactggagcagaagggtctcactcgcacttgggagtgcagggtggcatcggacagcaagttagcaaaggtgtcatgaaggaggggtcctgctcccctgtgtgctgaaaggtgagaagtgccccagcaaagggtgggagtggaggggtcggtgagctggggcagtgcaggctggcgagagccctgggggctgtagaaggtgcttggcagtgcactgaagacagtaagtgaggcctgtgggaggacaaaatactcacggtctttctggtggccctcttcatctagataaatgttagtcttcatgttccagatgaactggtgtgccagaagctgggatttagacgctgcccacagaatatactcccgcacatagcccatctgcaggagagcaaggtccctgtcagccaggctcggccctctccatgaggagggccttgtcagcagctgctgactcccggcatttggtagaccaggcaagggtaaggcccggtggctctagtggtgtggacaagctctccaggattgatgttgagtccagccagtggccaggccaagttccagctggctgggggctgggacctggggggcagggttgcaaagcgggcgacagtcagcctttgtctcctctgtgtcttcccatgggtttaagaagcacaactctcaaaccaatttctggagttgtcaagtacgagaaaaagcaggctgggtactaaaaactcacttgtgagctggttgtttagaacaatgttccaaagtgacagacaggttccagaaacatgcagagatacctccttcacaaactgacacactgatatgattaggttttgtgtccccacccaaatgtcatcttgaattgtaatcctcaggtgttgaggaagagacctggtgggaggtgactggatcatggggacggttcccccttgttgatctcatgacagcgaatgagttctcaggagatctgatggttttataaatgtttgacagttcctcctacacacacacttgctctctttcgcttgctgccaggtaagacggacctacttccccttccaccatgattctgtttcctgaggcctccccagccacgtggaactgtgagtcaattaagcctcctttataaattacccagtctcgggaagtttttttgtttgtttgtttgtttttgagacagagtctcggtctgtcacccaggctgtagtgcagtggtacaatctcagctcactgcaacctccacctcccaggttcaagcaattctcttgcctcagcctcccgagtagctgggattacaggcgcacaccaccacatctggctaatttttgtatttttagtagagacagggtttcgccatgttgttcaggctggtcttgaactcctcacctcaggtgatccacccacctcaacctcccaaagtgctggaattacagttatgagccaccgcacctggccaggaagttctttatagcagtgtgaaaatggactaatatacacaactgtggtcaccatcctaaggacctatcctcctcttccttcttggtcattttccgccactcatagtagtaactccagtttttctttttaattaaaaaaattttttttgttcctagagccataagttttgaaactccagttttaattccatgccctaggtttaaaaaggtgagctggcctttctgggcagcctcctggagtctgtggccactgatctggtgaagtgtcccttggatggacatttttgacctgggtgagtcgggggtggtcttaccacacaggcagaagtcttcactttgggtttcccaattctaacccggcaaatggatctaaagacaaactatgaatgttcaatgtgtagtgtttttaaatataagtttgctttttaattatgtaaacactgacagagttccaaagtcaaaattattaaatatggtacatatctgtcagttccatcctgatctctccctctttggccatttttattaacttttgatttactgttcctttttttttttgagacagagtctcgctctgtctcccaggctggagtgcaatctcagctcactgcaagctccgcctcccgggttcacgccattctcctgcctcagcctcccgagtagctgggactacaggtgcccaccaagcctggctaatctttttttgtatttttagtagagacggggtttcaccgtgttagccaggatggtctcgatctcctgacctcgtgatccacccgcctcggcttcccaaagtgctgggattacaagcgtgagccaccgcgcccggcctactgttccctttttttgtaaaagtataaacaaatatgtatatacatttgtattgccatagtgatataaatttttttaaacttaaaaaatattccaggctgggtgtggtggcacacgcctgtaatcccagcattttgggaggccgaggcaggtggatcacctgaggtcaggagtttgacaccagcctgaccaacatggggaaacctcatgtctattaaatacaaaaataggctgggtgtggtggctcacgcccgtaatcccagcactttgggaggccaaggcaggtggatcacctgaggttaggagttcgagaccagcctggcaaacatggtgaaaccctgtctctattaaaaatataaaaattagccaggcgtggtggtacacgcttgtaatcctagctactcgggaggctggggcaggaaaatcacttgaacctgggaggtggaggttgcagtgagccgtgatcgtgccactgcactccagcctgggcaacaaagactctatctcaataaataaataaatatttattatttttttgagacggagtctcactgtatagcccaggctggagagcagtggcatgatcttggctcactgcaagctctgcctcccgggttcatgccattctcctgcctcagcctcccaagtagctgggactacgggctcccgccatcacacctggctaattttttgcatttttagtagagacggggtttcactctgttagccagtatggtctcgatctcctgacctcgtgatccgcccgcctcagcctcccaaagtgctgggattacaggcgtgagccactgcgcctagccattaattaattaaaataattaaccaggtgtggtggcacatgcctgtaatcacagctgcttgggaggctgaggcaggaaaagtgcttgaacctgggaggcagaggttgtagtgagctgagatcacaccattgcactccagcctgggcaacaagagcgaaactctgtctaaaaaaaaaaaaaaattctggctgagcgcagtggctcatgcctgtaatcctagcactatgggatgccaaggcaggtgaatcacctgaggtcaggagttttgagaccagcctggccaacatggtgaaaccctgtctccactaaaaatacaaaaaataagccgggcgtggtggcatgcaccttcaatcccagctacttgggaggctgaggcaggagaactgcttgaatctgggaggcagaggctgcaaggagccgagaatgccactgcactgcagcctgggcaacagagcgagactctgtctaaaacaaaacaaaacgaacaaaaaaaaattccctaaaaatggaaagcaagaaagaaaccagtgaaactagctgagtcctgagttggtacaaccacacacagaagaatcatttcaggcggcctttctctggtagccaccaccaagagttcacacggaggccctgggtactggctcccctccccactgcctctggatctcacccttatgctaggcctgtatgcaagcagagagccaagcagtcaagggaaaataatgtgggaggggagccagggggaaggaaacaggttgctgaagagaaggtgcctcatgacaatcctgtaagttgccaccagtgtgaaggctccggcttggtgagtgtggctccacacatatcaccactcagaggcgcagagagtgtggcactacctagtgagggcagtgaatgattccacaggactcagtctttcagcagaggctggctgctgttctagaagcactttggtctacagactccaaggctagcccctgggacacccagccatgtaactcagccagcccacaggtgggccagagtggtgaggactcagccaggacacatggagtctgctgcccaattcatccagggaaatgaggtcagccctggggttggggaatagggcagacaagctgcactcagacacagggtgcagtgggcaggctggcgcgagggcagaggcggctcgggctcctggctgtggtcattcccatggatattttctgtgccatgacctgtgctgagcactttatgtccatggatactgttacgggctgaactgtgtcccttcaaattcatatgttacaggacctcagaatggtactgtatttggagatagggtctttatagagatgattaaggtaaaatgaggtcaatagggtgggtcctaatctagtatgacaggtgttcttataaggggagattaggacacagacacacacaaaaggatgaccctgtaaggactcagggagaagatggctatcaataagccagggagatgggcacagtggctcaggcctataatcccagcacttttggaggcggaggtgggcagattgcctgagctcaggagtttgagaccagcctgggacaacatagcgaaactccatctctacaaaaaatacaaaaattagctgggcgtggtcgcacacgcctgtcatcccagttacttgggaggggtagcggggaaggtgctgaggtgggaggatagcttgagcccgagaggttgaggctgcagtgagctgagatcacgccactgcactctagcctgagtgacagagcgagaccctgtctcttaaaaaaaaaaaaaaagccagggagacaggcctcagaaggaaacaaccctgttcgaacaatgaccttggacttctggcctccagaattcatgttttttgtttgtttgtttgttttgttttttggcctccacaattctgagaatgagaatagacatttctgtcgtttaagctgcccagtctgtggtgcttcgctatgcagccctggcagactaatgcatatgtcatctcgttaattttcctcaccacttccggctgaagagggcaggattcagggatttgaggggaccccaccgatgagagggaagcctggccaggctgcctagccaggctggcaacagccccagaaccggctcgctccacagagcatgcttgggcctcagggtgaggcagtgggtgaacatgggtatcaagggacaatcacagggcctggggtagggggagcaaggggactgctgggcagccctgcccctgaggaggctctgaggagcctgtgagggctggggacagaccgggcacaagctggtgtggaacacactctgtgagtgaagaggacggccatgcaggtgcaggcttaccttgtcgtacctgagggcctgcacaatctgggggatgtagaagaggatggcgtcctgtggaggtggagcagagttggccatgacttctgagagcagagccacccaaccctacggcccaggccctgcctctgcttctgctctgcccacagcagggctgagaactggggaaagcccagaggatggcaggcaaaatgaccgatggctcagaacacaggaatggaggaaacaggtaaaaggagcaaggctcccgctctacagcgggcgagggcctcgtgctcctcactagggagcctgcctcagggaatggtctgctgtgggtcagactctagaatattccagagacccttctccaccatcatcatggctatctcgtgggctccctgggctcccacaaggagtgagggaccctccacgggtgaggtcactgtggggttccaaggcacagctagctgcactgctgtgtggggtgtgcacagctgccgcgccgcctcgtaatcaaactcaagttaactttatgtctttaactcaaacgcctcactagattaaaaaacaaatgtaactagagaacacatttgaattagaactaaatccatcttctacaactacttgagcaaaaaacagggaaaggaccagtatgtaacggggcgacctcatggccaatggtggggcctgtgcctctcaccaggtaagacccctcccaacagtcctaccagaggccagctcagcagggccctgggctcaccggagggaaggaccgcaggactttcaccccgtactgcgccgtgagagggtgcggcgggtacatgctggagaagtaggagaggcctgtgggtgggtccgtgggcgcccagcacagcacatggctgagctctggagcatcggcgtcgatggtgtgccaggtgaccaggaactgcagagaaggtggggagatgctgtggcttgggcagtcccgggacctctggaaatacctggtccacgggccacacaaggacggccatgagaagtgatgtttctaagcatcggtaaccatggggaagatgcttctgatgtgttatggaaaacaacgtaactgcaattagggtgaagtgcattacatttttttctactgtgaacaaaataaatgctacagacaagaaatagaaaacacaggaaatcagaaaaaccatgaatagcactgaagttgccaagcggctgtttttgtctcatttctagtttcaggcatttctgggtgcagtgtgctattttgtgcagtttgaactcaggccctggtacgtgggctacactaccttgattgcttcaggcacatcactaacggctcccgggtccaaccgaacgagacgggtcacttcgttcccaatggcttctgtgttcttaaacctacagtgcacagagggtatgggtggtgctgcctcgccagggaacctgcactctcccaccacactggagtgaggggagccagggggaaacactgaactggagggattcacatcaataccaagtgacggcttgggtacaaacaaatagaaagaatgaagacctgctatttgatagcacaacagggggactacagccaataataacttaattgtatattgaaaaataactttaaaagagtgtaactggattgtttgtaactccaaggacaaatgcttgaggggatggataccccattctccaagatgtgcttatttcacgttgcatgcctgtatcaaaacatctcatgcacctcataaatacagacatctactacatatgcacagaaatttaaaaaaaaagtttaaataaaaaaatgtttagccaggtgacggctaaatgttctattatgccactaactagtaggtctgaacattagtgttttttaaaaagaggattataatctgctgtgatgaaatgctggaactttcttaaagaaacaggaatttttctacacttaactgtttaaagggcttcctttcaccatccttgtcttaaaacccctgcctcttactccttttcctaccatatcctctcctgactctccacagctgctcatccagtgagtcagtgtctcagtcaacagtccaggggccacaaggcacctggtccatgaaggggcagctactggtttccaggtgttcccacctcaggctaatgcaaggcggatgtcccatgagcactgtgctttgagacaatgcagagctgcgctgcgatcctattccagaggatcaaagtagggctggagagaggatgcagtacattggcaagtctgggctcacaatggagaatcacccaccctggacacattcacaggaggctgtggaccatctggtgggattctaaacagggactctgcagtccctctcagccaccatcggtctgaagttctgtccccataagagctgccacagagagatcacaggaatgtcactgctgtctgcagcatgtgcctcctccaaatactctgccactgaaaggtgacatccaggaacaaacccaaaccctccccaaggcggttccggcagccacctgccaggagtgacagcctccacatgcttcctatccggcaggaatcagatcttggctctgaattcaccctgctgctacctccctaggctccagctgctgcagcaccccaggcaggcatctgaaaagatcacgagggttgctgggttatctctgcacagaagggctcggggagtgtcctggggctcgaggactagactacttcctgactatccttgaaaggggctgcagggcactcctgagaactcatgacccagctggcaagcaccctgcgctggacctctggtgaggcctgtgtcaggctgtggtgcccgggggcccacctggcaggcagctgcacggctaggtagggagagatgctccaggcgaggttcacgttgtccttccactgcttctcactcaggctgatgtacttagatctccagttggccacgctgttctctccggcctggtctagttccagttccggggctgacagcgggttgtaccatgtgatgagacgctcgatctcagtggcctggcaagataagacataaggcctgatatgcaccccttctgtgagtgcccacacactgccccggccaccaggtgtcgtacaggcaggtggcgggcagcaggcacagctgcacctgtgggccttaccagcagggacagcagcagcgtcctgcgcttcatgtagtatttgtgcagctgggagccccggttggttttcttagacatgcctaggaggaaagacaaagcacaggtgtagtcctcagatgctacctgtctgccctgagattctaaacctagaggaagcttgcagtgctctgttctgctgtctgagcaagtgtccatcaagcagcttgcaactagaatgatagcttgcatgtgatggccccagcagcacacctcccaccgacctgatttcttggagatggtggacatgccgctggacagggggtatgtgttgatccagccttgggtggcttgttgccgagagccgacagttatgtccaggttgctccgggtgtcctgattatctgagggcaaacacattgttgattctagagtgaggtggctcaagaaaaggtaccacaaaaaataaactactattcaccagagataaagcaattagtggcagagcaggcattttctggagtcctggaatcgactgcaggaacaaatctgtctggatggtgggttttccaaaagcatgagaagttctttattttaactattctagatggaatgtttaaacatttttattatatttcttttaaccttttcaaaatttatttatttatttacttatttatttttgagatggagtttcgctcctgttgcccagggtggagtgcaatgacgtgatctcagctcactgcaacctccgcctcctgggttcaagtgatcctcctgcctcagcctcccaagtagctgggattacaggtgcctgacaccatgcccagttaatttttgtatttttagtagagacaaggtttcaccacgttggccaggctggtctcaaactcctgacctcaggtgatccacccacctcggcctcccaaagtgctaggattacaggagtgagccactgtgcccagcctatgttttatttttgagaaggagtctcgctgtgttgcccagactggagtgcaatggcgcgatctcagctcactgcaacctctgcctcccgggtttaagcaattctcctgtctcagcctcccgaatagctggactacagacgcccaccaccatgcctggctaatttttgtatttttagtagagatggggtttcaccatattagccaggctggtctcgaactccttacctcaaatgatccacctgccttggcctcccaaagtgctgggattacaggcgtgagtcactacacctggacttcttctagcctttaaaatagaataggctgagcacagtggctcatgcctgtaatcccagcactttgggaggctgaggcaggtggattgctagacgccaggagatcgaggccagcctggacaacaaggcaagacgccctatctctacaacaacaataaaaattagccaggggacctggcatgtgtctgtagtcttagctgcttgtgaggctggggtgggagaattgcttgcacccaggagtttgaggctgcagtgagctatgattacactattgcactctagcctgcgcgacagaatgagactgcatttctaaaaaaaagtagaaaataaaatagaataaaacaaatatcataattttcttgataaaagatggcagttatctgatcaccggcaacgtatagtcctttagtacggtgacaacttgagggcctgtgggggcagactgtaaggactgtttgccctcttctaagtggagccagaaagctgccttagaaagtcactgcatctgcttttttctttccttttcctgctagttaggttgtcagccgtgggtctgctaaagaaaaccatctcagccaggcaatgtggcccacacctgtaatcccagcactttaggaggctgaggcgggcggatcagaaggtctcagccaggcaatgtggcccacacctgtaatcccagcacttcaggaggctgaggcgggcggatcagaaggtcaggagtttgagaccagcctggccaatatggtgaagccctgtctctactaaaaaataaaaaaattggccgggcacggtggctcacgcctgtaatcctagcactttgggaggccgaggtgggcagatcacgaggtcaggaaatcgagaccatcctggctaacacggtgaaaccccatctctactaaaaatacaaaaaattagccaggtgtggtagcgagcgcctgtagtcccagctacttgggaggctgaagcaggagaatggtgtgaacccgggaggcggagcttgcagtgagcggagactgcaccactgcattccagcctgggcgacagagtgagactccgtctcaaaaaataaaaataaaaaaaaaagtctgggcgcggagatcgagaccatcctggctaacacggtgaaaccccgtctctactaaaaaaatacaaaaaattaggcaggcgtggtggcaggcgcctgtagtcccagctactcaggaggctgaggcaggagaatggcacatacccgggaggcagagcttgcagtgagccgagattgtgccactgcactccagcctgggcgacagatcaatactctgtctcaaaaaaataaaattaaattaaattaaaaaataaaaataaataaataaaattaaaaaattagccaggcatggtggtgagcacctgtagttccagctactcaggaggctgaggcaggagaatcgcctgaacccaggaggcagaggttgcagtgagccaagattgcgctactgcactctagcctgggagaacagggcatggcctccttacagaggtttgctgcttctttgcgtggcatgttttcattcggcatacccttccctggaatgctttgccctgtccaccctgcatgccggtgcagccattcagactcagctcaactgtctctcttccagaaaaccatctctgattcctcaactctggatgggccaagtgcctgtccccgaggagtgctcccatagttccctcatattgaaatcacctgtccatttgactgcctcctacaagacaacaacagaccataccccagtcatgtgggtgtgcaccagcctcagcccaatcctgggccgtcagctgctcagaggggtgtgtgaacgcagctggtgccagtgcagggaaagtgcggtgagtggagtctgctcagctgcctcgggtgcgtgtttatgcttctcagctcaggccagaggagaagcagagccaggcatgcaccggcctccaatgaccgtgcaacacagccaaggccagggctcaggggggtctaactgcttttccgtccctacctctggcaccctcggggcagcccacgtggcacccctgtcctgcctgcctccaccatgagcagctgcactgttgagggttacctgggggaacaagctggctggcggtcaggtacttcttatctgagaacatggcggtccaaaatttaatcatgatgcttatgtcttcacgcagccgcttctctccttgagtagggaactttgggggacagcttcaaacaaccataagaggacaagggctgagtgtctggagtcagggactagaggccagtcacacaaagcagtgagaaggtgatgcagacagtttcttaatgacaaaaggtcagcccaaagccagtcattagcaaggatgatctggcccattcccatgggaaggtgtggtggctcgggagccctcttatgccctcctccctcactgcccacagcagcccctacagctttccactgaagctgcacttgtggcagatcagggcaaggaagctgcactcacacaacagcacagcctatgggtgcagagccccaggcagtgggtgtttgcaattcttcgtgcaataagccttcacattaacagggaaattaaatggacgcacttaatctcctaaatcagttgaactgagggaaaatttgcctacatctcgctgggaggctagctctaagtacacgggacacatgcacagggctgaagggtatttaaatccacagggccagggatactgaaggaggaggttggtgagcacaactgggcaactgtgtattcctgtgagtgacttcctgggggtttggggcgatggagcacttggaggggctgcgccgtccctggacgctgcacagcacatcttgggggagtacctgaagtagtcaaaggcagtggagtagatcttctcgcgaagcacattgcggatggttgcatttggaaccacatcggcatgcaggagggacagccccagggtcagcagcctgtgagggagccccggacccagttagagcaggagcctggcctggggccaagttcaccttatggactctcttccctgcccttccaggagcagctcactgaaatgtgttccccgtctacagaagtaccgtgatacacagacgccccatgacacactgtacacaccaggggccctgtgctccccaggaagagggccctcacttgaagcggggcccgatggccgccacgtgccggttcatgctccccttggccccgccgatgttcagggacatggagcgctgcagcaggctggagaagatctccacttggtcagagctgcagtacttggcgatctcaaaccgctgcaccaggaactgagcgaaaagaggaagacgctgtggtggtggggctgagccgggctaaccctggggccggcagagacagctgaggaggggttctgggctgactggccgagcttgccgaaggccttgggctcggctacccccaccccaggaacagtcctggccccccaggtggagcaccccacagccttcgtgggggaacaggcacgtacgtcgatccagatgtagtggggggtcacttcggggggacagggtttgggttgacttgcttccgaggcagccagggggtctgcttcctttatctcagcagaaaacaggccaaatttctgctccaccgtcatgtgccaggcccctgccatctcccgcatgaactacaggtacagaaggaatgttagctcctctgtgaaacacaaaaaggggctactgtcaagttttctctaattaaaaaaaggaacacgtgctcactgaataagatttagaaacca

SEQ ID NO: 1060 - DNA, 151092 bp, Homo sapiens
ttccaacacagcactattttgggtttttattttgttgatgttggttaaatcttatctctttttttatacacaatacttcatgtacctatgaaataagacaggtagggaatatgtccagtgcaaacagaggactcacacctgtgcatagacagcaccatccattgattgtcgctgcagtccatggcgttaccaaggctgcgccacccacgtgctgccccaggaggcgctaccaggttctttgggccacaggcctctcctccactgcatgtggcggcagggcagggaggtcgcagggctccatgattgtgggacagctttgagggcacatggggcagaggccctcgaaggtcccctcctcagtaggggatgtcattctgatagtactggatcatgtcgtaggtccggctcctgaaaggccaaggaagagtgaagggagattcgaggagccagcagggtctggggtccctccccacagggagccctacctgtccaatcagccccttatggctgcccagcacctgaaggtacaaatgtcccaggcgtgccctcccccacccagtgaccacatctcctgctccaacccgggggactccgaggccacctcatgctcctcagccaaaccgcttccatccgtgggagccactgctctgccccatgggactcgggccccttggctcgtcctggccagatgcctccaaggggtctgtacgctctcctcgcacctctggagagccccttctcgccctgccccagcccctcttgaggtcctggccgcctggcttctctgcttcctatcagcaagagctccttccgtgcccagcctccacagtgcccttgttagggtgccggacccgggcgccacctgggggcaggtctcagcttcctctcacgctcctccggcagttccccatgcagatggccacacctgggcccctcctcctagtctgtgaatgtggtctgtcccatggcacagccttgggctcccacatgcccctcagggccttaccaaccccacatgtttaagtgctgcccccttcggggatggctcacttgctgggatcgccatcctccctttgttcaggccggacccctcaaagccacctctgactcccacagcagggagcctgtcagcccggtgctctgccttcagaccctgagccagccctccccagggccccctgcacccatctcctcccaccacagtagtgaccagcagcccggcctgcacctccagtcactgcccacgaagcagcccgaggcaggcgcagggaaggagtgggctctgactcctcagccctcctgggaggagggaggcctgacaccacactcagttctaatactcctggccttgtgtccctattgctccttcggcctcacgagccctgcccaggtgggcccggcctctgccaagtgttcccctcggcacaccacagccccctaaaccagcaccccactgctcctcaagagctcctgtcaagacttgggtcttcatgagaggggcggcttggggacagcagaatcctcatcgcctggtgcaggcaaggccctgcaggtgcccagtggccaccgaggcagtgggagaaggcaggggggcggggcactcacctgttgctgaggaagcagctctggatgaccttcatgatgaaatttgcagcctcgcgctcagtcatgttggggctaaacctgtgcctgggggagaggctgtgtcagggctgccatgggcagggccgtgctggctccctggcccagtgggaggagggtcttccatggggacggacttcagctgagagccacgccctggaaatgtacctttggggtccacatgttggaagatggggtgctgtgaaggccacgcctggcctatcatgggccctgtccccttcccagcatcacctgagtggccccatggcattaggggactaagcattggggagctaagctactgcagccccagaccttagggtggaggtgggttgggcgtagcatccttgacataaagaggcccctgggtgggtctctggtgtggccggcacaagcaggggcccctcacagttgtggtctaggggcagagcctcacccaagaaccctgtctgctctgaggttccaaggagatgacaaccacagtgacaattacatgaaaggtacctatcttggatggagcctcagctaatggacaactgtcccccagatggcctgcgtgtccaccaaggaacctacttcaagagcttgattgtctggccgcgaaaacagggcaggcccgtgtccaacatgagagtgaccagggagacgaccgcgtccatgtagggcctggggagagataggagggagcggtgggctgaggccagcctaggtggtggccctgcctgtagtcctgtggactggctgatgccaacagcctcaggtgtgggctcctgccacccacctcgcctgccacatcttgcacatccccgaggcaactttcgatctgctgcacttggtaacccataccgcccaggcaagggctgcccacacgcactctggacaggctgagtgtcctgccctgtcccccacataaggctgccggccatggcttctgcacttgggtgggatgcagacacgctgacctgcctttctctgcagggcagtggggatgaacccaggttggactgtggccttggccaagtgacctgtatatgaaactgggacaaagcccatctttggcacgtagcctgtggggtggcaggtgctcaggctttggtgacagggtggatgggatgcccagaaagggagagcccatggctgaaggcgtgggcaggatcgtggggaaggtggttggaattagatgtccagagcaagaatttactggcacaggtgggcagacagaggtgaccaaaggacaggtgtaggtcagcaggtggctgctagcacctacctcactctctggaaccggattcccttcatcctaaaggggatctcagaacgttccacacaccccctccgcctccaccctggccctcacccaggctcaccgcacagccaggtagcctcggacacacatctccatgaaccacttgaagggtgtggcctccatcttgccccccatgatcatcaccatctcatccgtcagcttgatgtcgggttcccagccgagattgccgcccggcgagctttcaaacatgaagccaaagtctgcaaaaccccaaagagctgcctgtgactgggtaggagccagggcgggcaaggacaagtggtctgttttgaggagtggaaaaggactgcaacaggagcaccccctccacccccaacaggcaggttgtgttttcttggagacagtgatggggtgggtggtggggcagcaggcagagaaagagaagggaggaagtggaggaaggagccaagctggggcactgaacctggaccagccccactccgcccagctccagcttctgactcagagcaatggcggctctcgccctagctccctggggccggggccaggcaccctctacagcagaacagcttggtggccgacagttcggacctcagagctggaccctgacactcctggcagggtggtcctgggcattctcctctctgtggggtggggatccctatccacccctgggtgccaggggtgaagggagaggagggtggcgctgtggctggctgaccgatgtggatgatatgacccttcttgtccagcataatgttgccgttgtgtctgtccttgatctgcagcaggaacagcaggaggctgtaggcggccatgcttcggatgaagttgtagcgggcctgtgcagagagcgccctgggctcaaaaaggccctggggcctgtgggcattctccctggtcccacacccaggatccctgggcctgtgggcactctccctggctctgtacccccactgtggaagcagagcccgaatcagcaagccagtcttcggtagcaggagtgacaggggctctctgtggaagtgggcgtgcaggcacttcctcccacactcagaacttaactttcttctaaggagtccaacccagccctacattcttttgactcccaaagtggcttacagatgccctggtgttttttttttaaatggagtctcgctctgtcgccaggctggagtgcagtggcatgatcttggctcactgcaacctctgcctcctgggttcaagagattctcctgcctcagcctcccgagtagctgggactacaggtgcccaccaccatgcccagttaatttttttacttttagtagagatggggtttcaccatgttggtcaggatggtctcgatctcttgacctcatgatctgcccatcttggcctcccaaagtgctggcattacaggcgtgagcactgcgcccggccaggtgccctggtttttttgtgtttttttttttttgagatggagtctcactctgttgcccaggctggagtgcagtggcgcaatcttggctcacagcaacctctgcctcctgggttcaagcgattctcctgcctcagcctcctgagtagctgggactgcaggcgcgtgccactatgcccagctaatttttgtatttttagtagagacagggttcaccattttggccaggatggttttgatctcttgacctcgtgatctgcccgcctcggcctcccaaagtgctaggattacaggtgtgagccaccgtgcccggcccaggtgccctggttttaacccttaacaaaggatgactgaggagagcagggtgtgggtggaggctgggtatgggtggctggggtggggtggagcacacacgacctcccccggcctgtggccaccctggctacctgctggaaggccagagtggactcatccccgtactggcgtgtgaagtagtcgtacatgccgaagtctgtctggcggcccagctggtcccgggaggtgcagtcggggatgcactcgatcaccccgcactaggaggaaaggccagttctgaggcccgctgggtgcgaggtgcccagggctgccctactggctccactcagggaacttaccccaggggcagtggccaccacgcggtagggaaaaacaaagaggtccaggccgaccagctggaagatgttcttgaagaggtcgatgatctgcagggccagcatgtcctgggaagccgggaggcgcaggatgcggtcagttggcgtccttgcaccccagcagctcttctggctcatgcagggcaaaagccaagcacccagagatggagtgaggtggggagaccacagccgagcaagagtctggaaggccttcctttctgaccaccgggggctggactcaggctgctgggaccaccaggccctgggctgagcatgaggctgagctgtctggtggggtgtgtgagataaggcacccaacccctggacagttccctcaggtgggcactggcatggcggggacagtgggaaaggggctggaaggagaggcctctgggttttgcagaagccctaatttaccccgtggcacctgaaccatataagagaaggaaaagattcacatttctgcatatgagattggactctggcgggcctggagccttggggagcagcaagcccagtccccaagcctactcgaggcctgaccctgcttacctgccggcagtcgtctcccaccttgaagatggctgcctgccaggagatcttctggccgtcggcctcctgcgtgctgcactcatcctcggagtctgagcggcaccgcagacctgcccgcagggagagaggccgctgttagcctgtaggcagtgagaagccctctgagggggccagggatgagtcctctcacatgcctgaaaggaaccccagcaatcttggggatcacttcttcaaaaccccaaggaggccaaggaggagcccagcagggcccaaggaaagccttggaacagcaggtggaatccagggttggagtctaagaacatttaggcttaaatggaactaaaaacagagccccatttcatctgcagtgaagacccaggtgtgcctgggtcagtgttgggtgctgtgagctagggggcaggaggaatgtgtctgtacactggggtcctgggagggctcggggccagcgtgcagacatggccatgggaggcaggtccctgcaaggggtggcagccccctctccacagctggccacaccgtctgtactgggttgaagagtgtctccctaaaattcatgttcaccccaaaccttaaaatgtgtccttatttggaaacagggtctttgcagatgtaattaggttaagacaaggtcacagtggattaggacagtccctaatccaatgactgatgtccttcaagggagatcatcatgtgaagagggaggcggagatgggagtggagcatctgcaggccaaggagtgccaggactgctggcaacaccaccagaagctgaggaggcaaggtgtgacctgcccagagccttcagagggggcacggccctgatgatggactccagcctccagaactgagatcgtccgtacggtagccctgggaaactaacaccccccaacagccccgggcccctcagcctcaggaaggagcctgctggagcatgccagctgactcacggcagacagacctctggggtggcacatctgtcagtgcatttgagctccctgccatcccccaatgagggatctgactgagtgagggcagacagatggacagacatcatcttttatggagagctatactaaatttaacacatgccagaagaaactggcattagcaaggaaaagcactgagctcccaaacaaaatcagggttctttactgaccttctttttcaagttcactaactccacatcgcttcaccttgaacttggccagatatggggcttttgcagcactgaaaacaacaaaaagaatgtggcacccatgatgcagccgagaaaaacttcgcacgcggacgcgtggaagtgggggatgggtagggtgaggcgcccacctctgcatcggggtcccagacttgtagtcgatgtccagcacaatggcctcagggttgctgggcaggtagcagcctgtgcagggacagaggcagtcacagggagtgcatgtgtcaccacaggtgagccagagtcagtttccaacacggatgttacatgcgtgtccaccctgcaggcacaccccgcccctgtggaggggcctctggtccttgtccagggcaccactaacttattattccatggccgctaagggtccgtcctccttgactcttcgactcttccagccatcaaccaaataagtctgcaccttctgggaaatgctcttcctggaggagcactgagccccatcctcacggatacagccctactgcttctgggggtgcgtgtgaggcctgtcctgcctccacctgcctgagcaaccctctgaacagccctccattcttggagtccttttttttttttttggatagagtctcactctgtcacccaggctggagtgcagtggtgcgatcttggctcactgcaacctccgcctcccaggttcaagcaattcttctgcctcagcctcctgagtagctgggattataggcgcctgtcaccatgcctggctaatttttgtatttttagtagagatggggtttcaccatgttggccaggctggtctcaaactcctgacctcaagtgatccacctgtcttggcctcccaagtgctgggattacaggtgtgagccactgcgcctggccttccttacccatttgaatactactctctcaaaaggcttacttaaatgtcactatgtccatgaactgtccttggttctcccagcctttaggacttttgtctaagacgtttctttttttctttttgagacggagtcctactctgtcgcccaggctggagtgcagtggctcggtctcagctcactgcaacctacgcctcccgggttcaagcgattctcctgcctcagcctcccgagtagctggaattacaggcgcctgccaccgcgcctggctaatttgtgtacttttagttgagacggggtttcaccaagttggccaggctggtctggaactccttacctgaggtgatccacccgccttggcctcccaaagtgctgggattaaggcatgagccaccgcgcccggccaacattgtttctttatgtttattttatatctctgtgagttcaagcttcttcagctcagggaccatgtcttactcatctttttaacagctacaatacctaatgtcatgccttttcttttcttgtttttgcttttttgagatagagtctcactctgtcacccaggctggagtgcagtggtgcaatctcggctcactgcaacctccacctcctgggttcaagtgattcttgttctcagcctcccaagtagctgggattacaggcacgcgccaccatgcctggttagttttttttttttgagaccaagtcttgcactgtcatccaggctggagcgcagtggcgcaatcttggcttactgcaagctctgcctcccgggttcacgccattctcctgcctcagcctcccgagtagctgggactacaggcgcccgccaccacacccggctgattttttgtatttttggtagagacggggtttcaccgtgttagccaggatggtcttgatctcctgacctcaggtgatccacctgccttggcctcccaaagtgctgggattacaggcatgagccaccgcacccggcccaggctcccctttctcagtgagtgctcagtaaatgtgtgaaataagaggacaagggaaagcctgtttctggccaaggaactgccagtccccaagggggatgtgtgctccttgagccctgagaggtgggctttgaggggagccaagcttggccttgctgtggggtacagggagaggggggcatgccatctcctcctcttcctcacctgcccttcttcctgctccaggctgtggctcacactcaggcccctctgtgctctcctgctagagccctgctggcttccctgacctctggggcaagactcagccaacacaatctagagccaggggctggggacttctgtgcatgccccctgcagtacaatgcttccagctctttttgcccctccccagcagttgtggccttcccgatgcgggaacagaggccctgcatacatgtcctgccctctctgggaagccgtgctgttgtgtgagctcaacacaatgtgttgggaagaaatggttaaaccggggtcctgcagggcactccacagctgagaccagccgctgtgaacatctgcacaggacagagtttggaagacaagtttgtgccaatagttagaaatgcagagagaggccgggcacagtggctcatgcctgtaatcctagcactttgggaggccgaggcgggcagatcacaaggtcaggagattgaggccatcctggctaacacggtgaaactctgactccactaaaaatacaaaaaaattagccgggtgtggtggcgggtgcctgcagtcccagctactcgggaggctgaggcgacacagcgaaactccatctcaaaaaaacaacaacaaaaaaagaaatggagagagagctgcccagtgaagtctggatttccatcttctcttgaaaagctcagcttgaattcccatgtggccacagccacaggcacccaggagcgacttcccatggaggcggtgggggggtggtgctgatgggtcccagcacacctgagccgtcccacactgggcccgccatcccctcgtctgtgtgacctgctcctgtaatgctggagcctaggaaccctcttctagagtaacagctactgaggtcactgtcagcctccagaaaaacagcaggcagcaaggaagatgaagggcacccactgacgagcagctcccgctcactagcggcagattctggggaggggctggggtcctggggcaccaggcaccgtgggcccaagcaggtgtggggctggccaagccactgtgtccacatcctgcagtgcctggagagggcagcagccttcacgccccgccgcccgcctgcaggaagaggttggtctgagcctccagaagccacctgctcacccggctgcaccttcacttcagacagggccgacagacaagccttctttctctcgtcgcctttagggtagggcctgagaaacaggaaagaaattcttgctttgtctcctggaggaactggctgctgggggacagcccagggcccctcctgcctggattgccctctctgtccctctcttcccggctctagctgctcctagcgcagccaggcaccactggcagcgattcttgccctgcattcctcatggagaatccccgacagccccggaagggctgttttctggcaggctctgcccctgctgtgtgcgggggtgtgtggctgggggtggtgggggtaataatgcctgccacctgctgccacccaggaaacgctagctcccgtccttcatctcgtgggttagaagctgccagcactgctattctcagcacccagcccagaaaaggacctcaaagtgaccaaggtcagagcagtgtaagcactggagacagcccagccagcgtgcccagcattgatgactccagggtttcatcccttatgaatgcacaaagccatcaacatccaaggatggtgtcaggtccacatgaatggaaggtctaggaaaacgatgacaggacctgcaaaggcagtctggttttcctgacaccatgaggatcgatccttcaaagtgtggagagggcagggtggcctcaaattgtggagccatgtgctaaattccacaaacctcaggaatgaaactaagctgtgtttcctgaaactggcgtggccgtgcattctgccataccttcaagagccctggctcaccccaagcagtgcttccccacccaccctggctgtccatcagaaccaccagcggccccgctgctagagactctcattcatctggttggggccaggcacgggtatttttaaagcttcccaggcaattctgttaagctgcagggactggaaggagatcccagaaggtggtttctgaagcactgcacttacttgatgatagccgacacgttggtgatcttgttaaagaaatcaaactcccgctggtaaaagtccttcgctgggccggacaaggagcctgtgatctcctctaccaactgatccaggaggtcgccgatgtcagctgccaaggaagcaaagaggcttaagtctctgtggctgtggcagaggcccctcaggaataccagccctgtttcccaggccccagactggcagtgcccagagtatgctctgcaggcttggtgagaccataacagctgccgtgtgccccttttgctgtgttgacacagctgacgctgctgggaagctaagctggtgcctaagcggagctcaaggcaggggccaagcgcacaagtggacgtggaatcctcactgctgcacacgctacacacgcaggaagaaaaaagcccgtgtcatttatgaatgtcacagggcatagaatcctcactgctgcacacgcagggagaaaaaagcccgtgtcatttatgaatgtcacaggtgaagcaatgaaaactaattcttattaaactctaccctgaatacatgtctttttttttttttaatagaggcacacagtgggcggggctctatattaaatagtgcctctcactattcaaatcccaggctgaatttaaattcctgggctcaagagatcctcctgtctcagtcacctgagttgctgggactacagctagtaggtgggactacaggtgcgcatcaccacatctggcttttaaagtatcctttgtgatgaaatgggatgtgcacgaagcactcttgccgcatctaaggcaggcgctgtcctgagaagcacctggagcttgtctgattttggagcctggactaacctttttcacagacctttgtttttacttgaagaaatgactgacagacaacatatagctattcagacttagggatgtggcagatgttttcctgaaaatgaacaaaaaataaatcttccactcaaaggaactgaaacatttttttggaaaacttggatctgctgctgtgagctcaacagcttcccttaaaaactctttctgggccgggcgtggtggctcatgcctgtaatctcagcactttgggaggccgacgtgagtggaccacaaggtcaggaaattgagaccatcctggctaacatggtgaaacaccgtctctactgaaaatacaaaaaaattagcaggcgtggtggcaggcgcctgtagtcccagctactcgggaggctgaggcaggagaatggcgtgaacctgggaggcggagcttgcagtgagccgagatcgtgccactgcactccagcctgggcgactaatcaagactctgtctcaaaaaaaaaaaaaaaaaaaaaaaaaaccctttctggtaagactggcagatgtgaacaaatatgatttttccacactgtacaaagaaatgcatcaacctttgaaagatgtgcataactcactggcctatattttacaaatgcccaccgtttgatgttataaaagcttttgtgggtccaggtgcgacgtagacagacttgaacaaaacacagcatgagaagtttactgccaagtttaagatgccacactgcaattaaccttttttttggcgatcctcctgccttggcctcccaaagtgttgggattacaagcatgagccaccatgcccagactgcaagtaatcattaagaagctaggctgagctacaaaaaattaaaaattagccagtcgtggtggcgtgcacctatagtctcagctacttgggaggatgaggcaggaggatcgcttaagcccaggtggtcaaggctgcagtgagccgtgattgcgccactgcattcctgcctgggagagggaccctgcctctaaaaaaataaaacaaaagctaccacttctcaagtgtggtgcagtatcaaaaagaatctccacaatgacctgagagactactaacatacaacttcctttttcaactacattcacttcaactgaaacaacactgcaacagatcaactgcagaagtggaacgagaatgagaatccagccgtcttctacaaggaaatgccactcttttggctcattttttagttttttggggaaagttattttcccaaaaagatgttatttatattaacatgtaatgaatgggcttacattttctgaaattctgtcttaatctctaatactcgttaacactgacagctaatgctcacattaaacagcgctctttgaggacctcaataaacatttctgacagtgcaggggtcctgaggctgtgctatttgggaaccgctgccctgggctgacggccccttcctcacatgcagtcacagttgtgttgaccatggagactctgcagaagcagccactggagcagaagggtctcactcgcacttgggagtgcagggtggcatcggacagcaagttagcaaaggtgtcatgaaggaggggtcctgctcccctgtgtgctgaaaggtgagaagtgccccagcaaagggtgggagtggaggggtcggtgagctggggcagtgcaggctggcgagagccctgggggctgtagaaggtgcttggcagtgcactgaagacagtaagtgaggcctgtgggaggacaaaatactcacggtctttctggtggccctcttcatctagataaatgttagtcttcatgttccagatgaactggtgtgccagaagctgggatttagacgctgcccacagaatatactcccgcacatagcccatctgcaggagagcaaggtccctgtcagccaggctcggccctctccatgaggagggccttgtcagcagctgctgactcccggcatttggtagaccaggcaagggtaaggcccggtggctctagtggtgtggacaagctctccaggattgatgttgagtccagccagtggccaggccaagttccagctggctgggggctgggacctggggggcagggttgcaaagcgggcgacagtcagcctttgtctcctctgtgtcttcccatgggtttaagaagcacaactctcaaaccaatttctggagttgtcaagtacgagaaaaagcaggctgggtactaaaaactcacttgtgagctggttgtttagaacaatgttccaaagtgacagacaggttccagaaacatgcagagatacctccttcacaaactgacacactgatatgattaggttttgtgtccccacccaaatgtcatcttgaattgtaatcctcaggtgttgaggaagagacctggtgggaggtgactggatcatggggacggttcccccttgttgatctcatgacagcgaatgagttctcaggagatctgatggttttataaatgtttgacagttcctcctacacacacacttgctctctttcgcttgctgccaggtaagacggacctacttccccttccaccatgattctgtttcctgaggcctccccagccacgtggaactgtgagtcaattaagcctcctttataaattacccagtctcgggaagtttttttgtttgtttgtttgtttttgagacagagtctcggtctgtcacccaggctgtagtgcagtggtacaatctcagctcactgcaacctccacctcccaggttcaagcaattctcttgcctcagcctcccgagtagctgggattacaggcgcacaccaccacatctggctaatttttgtatttttagtagagacagggtttcgccatgttgttcaggctggtcttgaactcctcacctcaggtgatccacccacctcaacctcccaaagtgctggaattacagttatgagccaccgcacctggccaggaagttctttatagcagtgtgaaaatggactaatatacacaactgtggtcaccatcctaaggacctatcctcctcttccttcttggtcattttccgccactcatagtagtaactccagtttttctttttaattaaaaaaattttttttgttcctagagccataagttttgaaactccagttttaattccatgccctaggtttaaaaaggtgagctggcctttctgggcagcctcctggagtctgtggccactgatctggtgaagtgtcccttggatggacatttttgacctgggtgagtcgggggtggtcttaccacacaggcagaagtcttcactttgggtttcccaattctaacccggcaaatggatctaaagacaaactatgaatgttcaatgtgtagtgtttttaaatataagtttgctttttaattatgtaaacactgacagagttccaaagtcaaaattattaaatatggtacatatctgtcagttccatcctgatctctccctctttggccatttttattaacttttgatttactgttcctttttttttttgagacagagtctcgctctgtctcccaggctggagtgcaatctcagctcactgcaagctccgcctcccgggttcacgccattctcctgcctcagcctcccgagtagctgggactacaggtgcccaccaagcctggctaatctttttttgtatttttagtagagacggggtttcaccgtgttagccaggatggtctcgatctcctgacctcgtgatccacccgcctcggcttcccaaagtgctgggattacaagcgtgagccaccgcgcccggcctactgttccctttttttgtaaaagtataaacaaatatgtatatacatttgtattgccatagtgatataaatttttttaaacttaaaaaatattccaggctgggtgtggtggcacacgcctgtaatcccagcattttgggaggccgaggcaggtggatcacctgaggtcaggagtttgacaccagcctgaccaacatggggaaacctcatgtctattaaatacaaaaataggctgggtgtggtggctcacgcccgtaatcccagcactttgggaggccaaggcaggtggatcacctgaggttaggagttcgagaccagcctggcaaacatggtgaaaccctgtctctattaaaaatataaaaattagccaggcgtggtggtacacgcttgtaatcctagctactcgggaggctggggcaggaaaatcacttgaacctgggaggtggaggttgcagtgagccgtgatcgtgccactgcactccagcctgggcaacaaagactctatctcaataaataaataaatatttattatttttttgagacggagtctcactgtatagcccaggctggagagcagtggcatgatcttggctcactgcaagctctgcctcccgggttcatgccattctcctgcctcagcctcccaagtagctgggactacgggctcccgccatcacacctggctaattttttgcatttttagtagagacggggtttcactctgttagccagtatggtctcgatctcctgacctcgtgatccgcccgcctcagcctcccaaagtgctgggattacaggcgtgagccactgcgcctagccattaattaattaaaataattaaccaggtgtggtggcacatgcctgtaatcacagctgcttgggaggctgaggcaggaaaagtgcttgaacctgggaggcagaggttgtagtgagctgagatcacaccattgcactccagcctgggcaacaagagcgaaactctgtctaaaaaaaaaaaaaaattctggctgagcgcagtggctcatgcctgtaatcctagcactatgggatgccaaggcaggtgaatcacctgaggtcaggagttttgagaccagcctggccaacatggtgaaaccctgtctccactaaaaatacaaaaaataagccgggcgtggtggcatgcaccttcaatcccagctacttgggaggctgaggcaggagaactgcttgaatctgggaggcagaggctgcaaggagccgagaatgccactgcactgcagcctgggcaacagagcgagactctgtctaaaacaaaacaaaacgaacaaaaaaaaattccctaaaaatggaaagcaagaaagaaaccagtgaaactagctgagtcctgagttggtacaaccacacacagaagaatcatttcaggcggcctttctctggtagccaccaccaagagttcacacggaggccctgggtactggctcccctccccactgcctctggatctcacccttatgctaggcctgtatgcaagcagagagccaagcagtcaagggaaaataatgtgggaggggagccagggggaaggaaacaggttgctgaagagaaggtgcctcatgacaatcctgtaagttgccaccagtgtgaaggctccggcttggtgagtgtggctccacacatatcaccactcagaggcgcagagagtgtggcactacctagtgagggcagtgaatgattccacaggactcagtctttcagcagaggctggctgctgttctagaagcactttggtctacagactccaaggctagcccctgggacacccagccatgtaactcagccagcccacaggtgggccagagtggtgaggactcagccaggacacatggagtctgctgcccaattcatccagggaaatgaggtcagccctggggttggggaatagggcagacaagctgcactcagacacagggtgcagtgggcaggctggcgcgagggcagaggcggctcgggctcctggctgtggtcattcccatggatattttctgtgccatgacctgtgctgagcactttatgtccatggatactgttacgggctgaactgtgtcccttcaaattcatatgttacaggacctcagaatggtactgtatttggagatagggtctttatagagatgattaaggtaaaatgaggtcaatagggtgggtcctaatctagtatgacaggtgttcttataaggggagattaggacacagacacacacaaaaggatgaccctgtaaggactcagggagaagatggctatcaataagccagggagatgggcacagtggctcaggcctataatcccagcacttttggaggcggaggtgggcagattgcctgagctcaggagtttgagaccagcctgggacaacatagcgaaactccatctctacaaaaaatacaaaaattagctgggcgtggtcgcacacgcctgtcatcccagttacttgggaggggtagcggggaaggtgctgaggtgggaggatagcttgagcccgagaggttgaggctgcagtgagctgagatcacgccactgcactctagcctgagtgacagagcgagaccctgtctcttaaaaaaaaaaaaaaagccagggagacaggcctcagaaggaaacaaccctgttcgaacaatgaccttggacttctggcctccagaattcatgttttttgtttgtttgtttgttttgttttttggcctccacaattctgagaatgagaatagacatttctgtcgtttaagctgcccagtctgtggtgcttcgctatgcagccctggcagactaatgcatatgtcatctcgttaattttcctcaccacttccggctgaagagggcaggattcagggatttgaggggaccccaccgatgagagggaagcctggccaggctgcctagccaggctggcaacagccccagaaccggctcgctccacagagcatgcttgggcctcagggtgaggcagtgggtgaacatgggtatcaagggacaatcacagggcctggggtagggggagcaaggggactgctgggcagccctgcccctgaggaggctctgaggagcctgtgagggctggggacagaccgggcacaagctggtgtggaacacactctgtgagtgaagaggacggccatgcaggtgcaggcttaccttgtcgtacctgagggcctgcacaatctgggggatgtagaagaggatggcgtcctgtggaggtggagcagagttggccatgacttctgagagcagagccacccaaccctacggcccaggccctgcctctgcttctgctctgcccacagcagggctgagaactggggaaagcccagaggatggcaggcaaaatgaccgatggctcagaacacaggaatggaggaaacaggtaaaaggagcaaggctcccgctctacagcgggcgagggcctcgtgctcctcactagggagcctgcctcagggaatggtctgctgtgggtcagactctagaatattccagagacccttctccaccatcatcatggctatctcgtgggctccctgggctcccacaaggagtgagggaccctccacgggtgaggtcactgtggggttccaaggcacagctagctgcactgctgtgtggggtgtgcacagctgccgcgccgcctcgtaatcaaactcaagttaactttatgtctttaactcaaacgcctcactagattaaaaaacaaatgtaactagagaacacatttgaattagaactaaatccatcttctacaactacttgagcaaaaaacagggaaaggaccagtatgtaacggggcgacctcatggccaatggtggggcctgtgcctctcaccaggtaagacccctcccaacagtcctaccagaggccagctcagcagggccctgggctcaccggagggaaggaccgcaggactttcaccccgtactgcgccgtgagagggtgcggcgggtacatgctggagaagtaggagaggcctgtgggtgggtccgtgggcgcccagcacagcacatggctgagctctggagcatcggcgtcgatggtgtgccaggtgaccaggaactgcagagaaggtggggagatgctgtggcttgggcagtcccgggacctctggaaatacctggtccacgggccacacaaggacggccatgagaagtgatgtttctaagcatcggtaaccatggggaagatgcttctgatgtgttatggaaaacaacgtaactgcaattagggtgaagtgcattacatttttttctactgtgaacaaaataaatgctacagacaagaaatagaaaacacaggaaatcagaaaaaccatgaatagcactgaagttgccaagcggctgtttttgtctcatttctagtttcaggcatttctgggtgcagtgtgctattttgtgcagtttgaactcaggccctggtacgtgggctacactaccttgattgcttcaggcacatcactaacggctcccgggtccaaccgaacgagacgggtcacttcgttcccaatggcttctgtgttcttaaacctacagtgcacagagggtatgggtggtgctgcctcgccagggaacctgcactctcccaccacactggagtgaggggagccagggggaaacactgaactggagggattcacatcaataccaagtgacggcttgggtacaaacaaatagaaagaatgaagacctgctatttgatagcacaacagggggactacagccaataataacttaattgtatattgaaaaataactttaaaagagtgtaactggattgtttgtaactccaaggacaaatgcttgaggggatggataccccattctccaagatgtgcttatttcacgttgcatgcctgtatcaaaacatctcatgcacctcataaatacagacatctactacatatgcacagaaatttaaaaaaaaagtttaaataaaaaaatgtttagccaggtgacggctaaatgttctattatgccactaactagtaggtctgaacattagtgttttttaaaaagaggattataatctgctgtgatgaaatgctggaactttcttaaagaaacaggaatttttctacacttaactgtttaaagggcttcctttcaccatccttgtcttaaaacccctgcctcttactccttttcctaccatatcctctcctgactctccacagctgctcatccagtgagtcagtgtctcagtcaacagtccaggggccacaaggcacctggtccatgaaggggcagctactggtttccaggtgttcccacctcaggctaatgcaaggcggatgtcccatgagcactgtgctttgagacaatgcagagctgcgctgcgatcctattccagaggatcaaagtagggctggagagaggatgcagtacattggcaagtctgggctcacaatggagaatcacccaccctggacacattcacaggaggctgtggaccatctggtgggattctaaacagggactctgcagtccctctcagccaccatcggtctgaagttctgtccccataagagctgccacagagagatcacaggaatgtcactgctgtctgcagcatgtgcctcctccaaatactctgccactgaaaggtgacatccaggaacaaacccaaaccctccccaaggcggttccggcagccacctgccaggagtgacagcctccacatgcttcctatccggcaggaatcagatcttggctctgaattcaccctgctgctacctccctaggctccagctgctgcagcaccccaggcaggcatctgaaaagatcacgagggttgctgggttatctctgcacagaagggctcggggagtgtcctggggctcgaggactagactacttcctgactatccttgaaaggggctgcagggcactcctgagaactcatgacccagctggcaagcaccctgcgctggacctctggtgaggcctgtgtcaggctgtggtgcccgggggcccacctggcaggcagctgcacggctaggtagggagagatgctccaggcgaggttcacgttgtccttccactgcttctcactcaggctgatgtacttagatctccagttggccacgctgttctctccggcctggtctagttccagttccggggctgacagcgggttgtaccatgtgatgagacgctcgatctcagtggcctggcaagataagacataaggcctgatatgcaccccttctgtgagtgcccacacactgccccggccaccaggtgtcgtacaggcaggtggcgggcagcaggcacagctgcacctgtgggccttaccagcagggacagcagcagcgtcctgcgcttcatgtagtatttgtgcagctgggagccccggttggttttcttagacatgcctaggaggaaagacaaagcacaggtgtagtcctcagatgctacctgtctgccctgagattctaaacctagaggaagcttgcagtgctctgttctgctgtctgagcaagtgtccatcaagcagcttgcaactagaatgatagcttgcatgtgatggccccagcagcacacctcccaccgacctgatttcttggagatggtggacatgccgctggacagggggtatgtgttgatccagccttgggtggcttgttgccgagagccgacagttatgtccaggttgctccgggtgtcctgattatctgagggcaaacacattgttgattctagagtgaggtggctcaagaaaaggtaccacaaaaaataaactactattcaccagagataaagcaattagtggcagagcaggcattttctggagtcctggaatcgactgcaggaacaaatctgtctggatggtgggttttccaaaagcatgagaagttctttattttaactattctagatggaatgtttaaacatttttattatatttcttttaaccttttcaaaatttatttatttatttacttatttatttttgagatggagtttcgctcctgttgcccagggtggagtgcaatgacgtgatctcagctcactgcaacctccgcctcctgggttcaagtgatcctcctgcctcagcctcccaagtagctgggattacaggtgcctgacaccatgcccagttaatttttgtatttttagtagagacaaggtttcaccacgttggccaggctggtctcaaactcctgacctcaggtgatccacccacctcggcctcccaaagtgctaggattacaggagtgagccactgtgcccagcctatgttttatttttgagaaggagtctcgctgtgttgcccagactggagtgcaatggcgcgatctcagctcactgcaacctctgcctcccgggtttaagcaattctcctgtctcagcctcccgaatagctggactacagacgcccaccaccatgcctggctaatttttgtatttttagtagagatggggtttcaccatattagccaggctggtctcgaactccttacctcaaatgatccacctgccttggcctcccaaagtgctgggattacaggcgtgagtcactacacctggacttcttctagcctttaaaatagaataggctgagcacagtggctcatgcctgtaatcccagcactttgggaggctgaggcaggtggattgctagacgccaggagatcgaggccagcctggacaacaaggcaagacgccctatctctacaacaacaataaaaattagccaggggacctggcatgtgtctgtagtcttagctgcttgtgaggctggggtgggagaattgcttgcacccaggagtttgaggctgcagtgagctatgattacactattgcactctagcctgcgcgacagaatgagactgcatttctaaaaaaaagtagaaaataaaatagaataaaacaaatatcataattttcttgataaaagatggcagttatctgatcaccggcaacgtatagtcctttagtacggtgacaacttgagggcctgtgggggcagactgtaaggactgtttgccctcttctaagtggagccagaaagctgccttagaaagtcactgcatctgcttttttctttccttttcctgctagttaggttgtcagccgtgggtctgctaaagaaaaccatctcagccaggcaatgtggcccacacctgtaatcccagcactttaggaggctgaggcgggcggatcagaaggtctcagccaggcaatgtggcccacacctgtaatcccagcacttcaggaggctgaggcgggcggatcagaaggtcaggagtttgagaccagcctggccaatatggtgaagccctgtctctactaaaaaataaaaaaattggccgggcacggtggctcacgcctgtaatcctagcactttgggaggccgaggtgggcagatcacgaggtcaggaaatcgagaccatcctggctaacacggtgaaaccccatctctactaaaaatacaaaaaattagccaggtgtggtagcgagcgcctgtagtcccagctacttgggaggctgaagcaggagaatggtgtgaacccgggaggcggagcttgcagtgagcggagactgcaccactgcattccagcctgggcgacagagtgagactccgtctcaaaaaataaaaataaaaaaaaaagtctgggcgcggagatcgagaccatcctggctaacacggtgaaaccccgtctctactaaaaaaatacaaaaaattaggcaggcgtggtggcaggcgcctgtagtcccagctactcaggaggctgaggcaggagaatggcacatacccgggaggcagagcttgcagtgagccgagattgtgccactgcactccagcctgggcgacagatcaatactctgtctcaaaaaaataaaattaaattaaattaaaaaataaaaataaataaataaaattaaaaaattagccaggcatggtggtgagcacctgtagttccagctactcaggaggctgaggcaggagaatcgcctgaacccaggaggcagaggttgcagtgagccaagattgcgctactgcactctagcctgggagaacagggcatggcctccttacagaggtttgctgcttctttgcgtggcatgttttcattcggcatacccttccctggaatgctttgccctgtccaccctgcatgccggtgcagccattcagactcagctcaactgtctctcttccagaaaaccatctctgattcctcaactctggatgggccaagtgcctgtccccgaggagtgctcccatagttccctcatattgaaatcacctgtccatttgactgcctcctacaagacaacaacagaccataccccagtcatgtgggtgtgcaccagcctcagcccaatcctgggccgtcagctgctcagaggggtgtgtgaacgcagctggtgccagtgcagggaaagtgcggtgagtggagtctgctcagctgcctcgggtgcgtgtttatgcttctcagctcaggccagaggagaagcagagccaggcatgcaccggcctccaatgaccgtgcaacacagccaaggccagggctcaggggggtctaactgcttttccgtccctacctctggcaccctcggggcagcccacgtggcacccctgtcctgcctgcctccaccatgagcagctgcactgttgagggttacctgggggaacaagctggctggcggtcaggtacttcttatctgagaacatggcggtccaaaatttaatcatgatgcttatgtcttcacgcagccgcttctctccttgagtagggaactttgggggacagcttcaaacaaccataagaggacaagggctgagtgtctggagtcagggactagaggccagtcacacaaagcagtgagaaggtgatgcagacagtttcttaatgacaaaaggtcagcccaaagccagtcattagcaaggatgatctggcccattcccatgggaaggtgtggtggctcgggagccctcttatgccctcctccctcactgcccacagcagcccctacagctttccactgaagctgcacttgtggcagatcagggcaaggaagctgcactcacacaacagcacagcctatgggtgcagagccccaggcagtgggtgtttgcaattcttcgtgcaataagccttcacattaacagggaaattaaatggacgcacttaatctcctaaatcagttgaactgagggaaaatttgcctacatctcgctgggaggctagctctaagtacacgggacacatgcacagggctgaagggtatttaaatccacagggccagggatactgaaggaggaggttggtgagcacaactgggcaactgtgtattcctgtgagtgacttcctgggggtttggggcgatggagcacttggaggggctgcgccgtccctggacgctgcacagcacatcttgggggagtacctgaagtagtcaaaggcagtggagtagatcttctcgcgaagcacattgcggatggttgcatttggaaccacatcggcatgcaggagggacagccccagggtcagcagcctgtgagggagccccggacccagttagagcaggagcctggcctggggccaagttcaccttatggactctcttccctgcccttccaggagcagctcactgaaatgtgttccccgtctacagaagtaccgtgatacacagacgccccatgacacactgtacacaccaggggccctgtgctccccaggaagagggccctcacttgaagcggggcccgatggccgccacgtgccggttcatgctccccttggccccgccgatgttcagggacatggagcgctgcagcaggctggagaagatctccacttggtcagagctgcagtacttggcgatctcaaaccgctgcaccaggaactgagcgaaaagaggaagacgctgtggtggtggggctgagccgggctaaccctggggccggcagagacagctgaggaggggttctgggctgactggccgagcttgccgaaggccttgggctcggctacccccaccccaggaacagtcctggccccccaggtggagcaccccacagccttcgtgggggaacaggcacgtacgtcgatccagatgtagtggggggtcacttcggggggacagggtttgggttgacttgcttccgaggcagccagggggtctgcttcctttatctcagcagaaaacaggccaaatttctgctccaccgtcatgtgccaggcccctgccatctcccgcatgaactacaggtacagaaggaatgttagctcctctgtgaaacacaaaaaggggctactgtcaagttttctctaattaaaaaaaggaacacgtgctcactgaataagatttagaaaccaagaaaagtatgaagaaaaaaatgaagatcgcctatagtcccacatcccagggtcatctgtgtcagtgcttggtgtattttctccagcctctcgaggctgccttctgttcaacccggttcaccgtgtggacattgcaggtgtgaggtggcagcacccgggatgtacctgatgccctgacaggcactgggtaggtgactcttctctataaccctgataaccctctgtggctgtgagcgggaagacccctctgtgggatgctgagctggcaagggcagaagagggttctggatccagagcctggctcctcctctccaccccacacagaccctacctgatgccttcatcccgctaaccagattaggaaaggcccatggagccgaggcgagcctgcagccaccatggccaggcctgggagcccagggtcaggctgctcccatggcccagtcatgctcagccaggtccccattccgtgggggggcatgaggggtgcccagagggagcagcatggtgcccgggagacacctgggtgctgcagagagtaagaggtgcagctcacacatggaaagcccccatgatttctgggtgtttttacaaggagaccaacaaacagcatttggcatctggccaaagaggattctatccctctgttgtcccagcagcaccagcttctacaagggctccaagcgcctgtgcagaggtggcaacgaggcctagtgagtagaacacacaccgcggctccctccccagtaccatcccctcccttcttcctcatgaggtggatcagggtggccacgtggccagtcacagggctctcagccagggtccctgctggctgaggcggccactgttctccccggccactctaatgagccagggagagtgaactgggcaaggccctgggaacacatgccagggtgagcttcataaggtcaaggcagctggcctctgccttttgcactctgtccttgtcttccttcctgctgggaggcacagaagccatctggaggctgtgagggtggagacaaaggccacataagcccaggatggccaggagccgacgggagcccggggcggggctctgtctgctgcttccctctaagctgcccatggggtgaggactcctgggggacgaggcactagagcctgctttctgtttcctgcagaccgattagtcttatggaagcagacaagggagaaaaaaatgggggggaccccagaactgccatggacaagaagccatggaagagacacactcccacctatttgttacacaaccacatcctggtggctgcctctgtgccagggcctcgtggactctgggcatggtgctctgaatgaagacaaacatgaccacacagtctatggtggggaccacagacaacaagaaataagctacacacactgagaaacactaagaaacagcagtgcgagtgagcgtgtgacagaccaggtggccagggagagccctggcaaggaggggatatctgagatgagccctggaggagacgcaggagtgaggcgcaaggcacggccatctgagaagagggaatgcatgacgcggcctatggtgggagcagcccaggagggcagcttcaaaagtgaaactgatgggatgtgctgagaatcatccgtgggaagtgcaagcaggaccccagcatggccacagcacagcaagcaaggggaagagagaggatggaagtcaggtgggaagggggcttgcaggtcacagaaacaagcccaccttcgagtctgtaggggggctctgattcccccctggcttgcgccaaccgcatgtggagaaggggaagatgcctggggttggggagcaggaggccaggccagagggcagcagctgggatgctgggacttgtcagatcctggataaacctcaaaggtgaaggtgatgggatgtgctgagagtcatctgtgggatgtgcataagagggagtcaaagacgtctgagcagacagaaggacctcgctggcatctacagtgaagggaagggccatgctggcatctacagtgaagggagggaccttgctggcatctacagtaaagggagggacctcgctggcatctacagtgaatggagggacctcgctggcatctacagtgaatggagggacctcgctggcatctacagtgaagggaagggtcacactggcatctacagtaaagggagggacctcactggcatctacagtgatgagagggacctcgctgacatctacagtaaagggaggggccacactggcagctacagtaaagggaggggccacactggcatctacagtgaagggaagaaccaccctggcatcaacagtgatggcggatgggcgaccagtgtagcggtgtctggagctgtggttggacccattagttggggctgctaatcagttcaccatgcaggctgtgggccaagccactgaagggatgcacctggactaggagtgactgggctgggtaagcagtggagctggccagagtacccaggcagggaggaggagccctggggcatgccagtactgagaaggccctgagctcaagaaggtccctttattctggaggatgaaagggctacaaaaattacaaaggccttaagtccctgggaaaagcagttaggctcccagaacagctgctttcaagacccagaactctgaaggaggctgtgagcagctttccctaggctgatctgtcctcctaccatctggggcctgctagtgatatctgtactccaactgccctgcccccaggggtcaaccaacccactcctatctgaggacccactcctatctgaggaccagacagggaggccagaagttcaagggcacctggactaaggaagtggagaggagagaggtggatctgggctccagagccccaggtacaatgtgagggctgacacgtggtcaggagcacccccagtgccctatgaaatgggaacggctacagcccctactctttttcttttttttttttttgagacggagtttcgctcttgttgcccaggctggagtgcaatggtgcgatcttggctcaccgcaacctccgcctcctgggttcaagcgattctcctgcctcagcctcctaagtagctgggattacaggcacatgccaccacacctggctaattttgtatatttagtagagacagggtttctccatattggtcaggctggtctcgatctcccgacctcaggtgatccacccgcctcggcctcccaaagtgctgggattacaggcgtgagccactgcgcctggctgagcagcccctactcttaaggcccaccgaggtctgaggctgaagcagcatatggaaaggaatcctgaccatagcagcactgtgtcctgacagtcacaatttgtggtgaaaccagggcttccagaagaccctgagaggagggcacacttgtcctcttctgggaagtggagagtcccaccaagagatagtgtgtaggcaggtgtgtgtaggcaggtgtgtgcaggcaggtgggcacctgggcccacacaggagtgagcgtggctaagacttcccaggatcgggtccctcctgagcccacaggaggacagcctcagggtgtgggggaaactgcaaccatcagcctagaccccaaggcctgggttcaatggacaggagagtaatatacatataatgccctgcttaagttgggcacacagcaggaccagagcaagttatcagttactagtgcagcccacatgcatttattttgggtcatgaattttaagtatcatacaaggatcatgaatctttcccctctcagtgaaatgaaggtcccagacccctgtaaggaggtcaggctccccactgttcccacgctgagatgcgaacagcaagtgtgacatctcttcatctcctgggcactatgggacctggacaggtcaggtccttgtggaggcagagacagggagtgaggacctgaatgaccacgtgctgctggggccagtgccaggtgtgagtgtgagtgggtggagaagcctgacacaggccaagggacctgaggccagctgagccactggagatggtaggagcaggaagtgcaagctggactccaaaagaccccaaatgaaacagtaatttggtttgtataaaaatccctttaagacacctttcccaattttgcttaaaataaaaaaaaaaggaagtggggtaaaaagcaggaagaacccatacttcctgccaagaccagctattgagtaggaggaggagccaccagacataagaaagacatctcggacaggcgcggtggctcacgcctgtaatcccagcacttggggaggccgaggcaggcggatcacaaggtcaggagatcgagaccatcctggctaacaaagtcaggagactcagtcacaaaaaaaaaaaaaaaaaaaagcaactggctgggcgcagtggctcacgcctaaaatcccaacactttgggaggccgaggcgggcggatcacaaggtcaggagatcgagaccatcctggctaacacagtgaaaccccgtctctactaaaaaatacaaaaaattagccgggcgtggtggcaggcgcctgtagtctcagctactcgggaggctgagacaggagaatggcgtgaacccgggaggcggagtgagccaagatcgggccactgcactccagcctgggtgacagagcgagactccatctcaaaaaaaaaaaacaaaaaaaagcaacaacaaaaaaagtcccagctactgggtcaggaggccgaggcagcagaatcacttgagctcaggaatttgacgtcagcctgggcaacatagcaagactgtcttcaggaaaaaaaaaaaaacaaaagaaaaaaaataaagacctccttctctctgggaaaatatacagcagtcctcctcaactgtcagttttatttaaatgtacaatgtccagtatagaaacaaaaactttcaaacattgaagaaaaaagataaaaagaaactgacccaagatgactcaaatacaagaacagaccagataacgatataaaaataattacaataaatatgctcaaagatttataagaaataatggaaagaatgcatgaaggtaagagaatctcagcagcagaaaatgcaaactataaaaaagaattaaatggctgggcgtggtggctcatgcctgtaatcccagcactttgggaggctgaggcaggtgcatcacctgcggtcaggagtccaagaccagcctggccaacatggtgaaaccctgtctgtacaaaaacacaaaaattagccaggcatgatggctggtgcctgtaatcccacttacttgggaggctgaggtgggagaatcacttgaacccacgaggcggaggttgcagtgagccaagattgtgccactgcactcctgcctgggcaacagagtgagaccccatctcaaaaaaaaaaaaaaaaaaaaaaaaagaattaactagaaatcctagatctggaattgtttctttttcttatttttaaattaaatatttattttttgttttgttttctagacctgagaattgtatctgaaataaaaaatatacaagatggttttacagcagaatgaataaagcagaagaaaagaacagtgaactggtatacaggttaaaaaaaaaattaaccaaatgaaagagtgagaaaaaccctgaaaaactgaaaaagactacagagaatgtcgatgatctatgggacaataccaagtcactaatatatgtgtacctggaatccaaaaaggagaagagagagagaatgaagtaaaaaaaaattaaaaaaatattgaccttaagagcctaggaagtaaaaaaaaaaaagaaaaagaaatgacaaagaaatactgacctcaagatttccaagtttgatgaaaatcctaaatccctgaaattaagaagctcaatgaattccaacaggataaatacaatgaaattcacacacagtcaaacaactaaaaatgaaagataaggagaaacatccaacaagtagtcaaaagaaaaacaataacatatacagtcatccttggtatcctcaggagaactggttccaggatgtggaacccatggatatggagggccggctgtactgagaaacaaaaagactgttgacttctctccagaaacaatgcaagctactagacaatagaagataatatctgaaatgctaaaaacaataaaacaaaaaactatcaacctagaatcctgggcctagaaaaaataatccatatgcatcaaagatgaaggtgaactaagatgagagaatttatttccagcagacctgcattactggaactgttaaagaaaattacttggcagaggagatcacaggaagactgtaaaagtgtgagtgatgaaaaacatttggataaattataatgctgtaacaaagccttgtcttaatttctttgaaagacttttgatttttttgaacagaaacaacattataaggtctaatgcatatagtagtaaaatatgaaaacaggacacaaggaattagagggagaaattgggtgtcataatggcagtgggtatccacagtggcaatggtatacagctgtctctgcagaatcctctccctggcaagaactataactgatgtggccactccagttgtcatttactgacagctcactaggatgcaggtgctcttgtaatgatgtccaccatgcaggtgaggagccccgcccaggaatcagagccctgcaggctgaagcgtgacttccacaggcccttctgcatatctttgatgggagcaggctggtcaggctgagaacccagcactcccctgacttcacaggtgtccccctgactagacaacctcccccaggcgcccactggaccaaaatgtttcctaacagcgctcaatggtgtgattgatacaaaccccacgaggttataaaatagcaggcaaatgtgagatattatcatcactgccaccaccaccagcccggaacattttaattacatttttggaaatattccaattttcctgagggaagaagaaaatcaaaatccccctttttgaccactcatttcaactaatcctaagaaatacagaaagaaaacatgtcaaattccctgctaccctgacagttaacagaatctttgaaaaataaaattgttcttaagcgtttatctaatcagctgaaacgtgagtataaacttccttgtgggcaccccctgcagtagcaactccagaaatacggatgcagggaaagggggctgatcccaagattaggtcaagaaaaacattcccgtggacaaacacaactgctcccaatcaaattcaaagttaacaggtgttcaaaaagctggatttccaatttcagtagagaaatggctccccctaccgaggttttgggagataacggcttctaggcaccagtgggatgctgttaacatatattctattttctgtgactgtcaggtataataatagaatctgtaaggagactgaggcttgagaaggtgaggggcttgcccagtgtctccatgcttggtggtggcggcaccagggaaggctcttcccgtctgttatcccatcccatcctcactgccaacccgaggtcagggtcctaccggcacttccactccatccttgccagccagcagccactcccagcaggccagggccgtctccatgccatgctcattgaacatccggaggggaccccagcacagatgatgaaggagctgcgggtcacaatctggaaccaaacacacgtcagtcagaggcctccaacaacagctgaaccccaaaacagcttccctgggccaacaagagttgaccagctggggccagtgatggccttttattgactttccactcatgagagatactcctctactgggggagctcctgctctttctccggccagtactccagctggctatgggtcatcaaggccagcattcatttagaaacgagcccagaattccacagtgcttcagtgagttacctttactgctaatgagcattgcggtcagcttgaacatggcctgcgtgtagtgctgaggatgactgcggtctaaagctgaatgtagatcctggaccatcattttgttcaggtcagacatctggcctgtggtgcctgagaaccgaatcattccatacacctgcaaaaacattctcatcagcaactaagcatataatccaggcaatgtgggtaaggttctggaagccaccagaccacacttgtggtggcactggtgggtgcctcgctgccccaaagtggagctcatgcatgcagagagacaggctcatttcaatgatgctaccactgatcacagctttttttttttttaaagaacagctcctctagaaatgcatgttggcagtgccaccactgcagatgttccccaagggtgggaaccttgtccctcatcattgtacccagcagtgagcccggggtctgacccatggtgggactgcatgaatgtgagctggataaatacatttcctcaaactcaattaatgactcaaacaacaatatcagcctcattattattttttgagagagggagtctcgctctgatgctcaggttggagtgcagtggcgtgatctcgactcagtgcaacctccgcctcctgggttcaagtgatcctcccacctcagcctcccaagtagctggattacaggcatgcgccaccacgcctggctaatttttctattttagtagagacagggtttcaccatgttggccaggctggtcttgaactcctgacctcaaataatccgcccaccttggcctccctaagtgctgggattacaggcgtgagcggccacacccagccctccttactattattaataattttttctttgagacagagtcttgctctgttgcccaggctggagtgcagtggtgcgatcatagttcactgcatcctcgaactcctgggctcaggtgatcctcctgtctcagcctcccaaagtgctgggattactggcgtgagccactgtgcttggccaacctatctatttttaaagacaaatataacttttttttccagagagaagaacatacaagtgacagagtgctaagaaggagtgaactcccactcagaccaggccactgatagactttcagagtcaccagggagcttagaaatggcatagactaggctgggcgcggtggctcacgcctgtaatcccagcagtttgggaggccgaggcgggcagatcatgaggtcaggagatcaagaccgtcctggctaacacagtgaaaccccgtctccactaaaaatacaaaaaattagccgggcgtggtggtgggtgcctgtagtcccagctactcgggaggctgaggcaggagaatggcgtgaacccaggaggcagagcttgcagtgagccaagattgtgccactgcactccagcctgggcaacagaacgagactctgtctcaaaaacaaaaacaaaaacaaacaaacaaaaagaaatggtatagattagcttctgagtttatggagcaggaaatggaggcccacagatgtgatggcactggtgaggctggaataaactgtggtgtggtgggtgaaagcccacgatgtggagttggaagatgtggttccagaccccactccacttgtgcgactttggcaagttacttaatcttgggaacctccgtttatctataaaactggaataataatacatacatcttaccgagtgcccaagagcctatggcatgtaagtgtttgttactgctgtaaaaaaaagccaaaaaaattaaaaaccttcattcagtgtagccaaagtgtacacagagttaccctcttgtggaaaaaacaagtaactggtcattaacactctggaatgtgccaagaatcctcctaaaatgtgctctttaaatcctcctaaaatatgttaattccacatcaccgggacgctttgttcattttccactaggaagcggccaacaggcctcaaaacaagaggacacgttaaaggccctagggcgcaaggacaagagaagcacctcgcccgcgtagcggttgcgcagattcagggatgccatgaagttggagtagtctttcttcacacaggccgggcgctcgctcagctgagttgcctacagacagataaccattattgtagactatggcagcactatcctttcctcgtgtttaccatggctaagcctaaacccaatgaagcagtcacactcgggtctgggggttactattaataaaaatcttcactgctggcaagttaataaagcaaaatattttagaatacccagcagtttgatatgttccataagaaattaaaaaaaaaagtctctggaaggcagtttctgctactggtaaataggcctttgcaagaaaaagaatcactagattgtgagagcaatgtcacctgtgatggaaacgccatgaaagcattcacagccgtctccttgagagttgcgtgtgcagcttataaatgtcacttacagaccgtaaaggggctgaaggggagagccaaggccagcaggctcttaaacatctgctggctgctcttcagtctaatgggaagagacagaaaagggtacaccttgaatacaaaggcaacccacagaatgggagaaaaatatttgaaaactaccgcccacccactccacccctccagccactctctctgcttcagcctcagcctcccagccccagggcctcagtgacctggcttcctaacccaggctggctgctgtgccacacctttcagttcctgttcatccacggtcactgcagagtacagcatgcattgaaaaggacctcctttcgcatttccctttagcatcagtactaatggggaaagtgagcttctcaactgttttgagtttagagggatttttttttgaggggacatggtgtggagaaagaggaccaggagaagaaaatacagatgttggggaacatcaaaatataaacaagaacaaaaatacatgatttctctcatgaaattattaaactggtttatttaaaaaaataaattacgtgaaactgctttacattttctggaaacaatgcggtctttggcaccaagcaggactgagttagagcttggctctgatactaatcagctgtgagaccttgggaagtcaatgtctctgagcctcaatgtgctcatctgtaaagtgggcataaccctctcacaatgttgttacacgttcaacgtaatgacacacacaatgtcctggcatggcaaacagcacctggtgggcagtgcaggccggctccctcccttccaccatcactcctcactgcccaatgcgatctcggctcactgcagcctccacctccctggttcaagtgattctcctgcctcagcctcccgagtagctgggattacaggtgcatgtcaccacgcctggctaatttttgtatttttactagagatggggtttcatcaaaaaaaaaaaaaaaaaaaagaatttttttttttttttttttgagatggagtcttgctctgttgcccaggctggagtgcagtggcgggatctcggctcactgcaagctccgcctcccgggttcacaccattctcctgcctcagcctcccaagtagctgggactacaggcgcctgccaccatgcccggctaattttttgtatttttagtagagacggggtttcaccgtgttggccaggatggtctcgatccactgacctcgtgatccgcccgccttggcctcccaaagtgctgggattacaggcatgagccaccgtgcctggccccagaattaatttttaaaaattaaaaaaaataacttagagaaaacctaacttacatcaaattttctggggaaaaagaacaaaatattttaggcaaaacagatctttcacaagtcagctggctagagtctagaaaaggcttacaaatgagaacacatattctattttatgtaataaagctttgctcctaccacccccaaaaaggaaaaggcttatgactatcataaacacttacagtctatgagttccgcctctggcctctgtggccacccagtggcagagacgtccaggtcagggcactgatacctggtgccccgtcagagtaggaggcccagggcgggtggccctgcaggtgcaggctggacccagctcaaccatgtctgctagactggtgtctttagagatagtgcagtgacctcgaggagagtgccctgatagcaaaatgaggcgagaagacaccagcattctctggcacatcctcaggccccacaaaagccagagggcactcaggcccctctctcccgccggtatcccaagggaggcctgtcacccttcctcctgggtacacagcctctgcacctccacatatcccatcccatgctccatttggagagagttgggaagcacacatggccaggctctagattcacattaaccaacaaaatctctgaccagccccagtcacatggccaggtggaactgcctgctttaatcctttttaactcttagctctaatttaactcagaaagtattgctgtgtgaaccctctgtcctctagattaatctctagcagaacaagaagctgaaggcattcatgtgcggttcagcacctgcagaaaacagaactgttcaggagtccagtatacgctccagataagtgcaactgtggcatcgcgctgcccgtgtcaggcggagctctgtttccatcctctcagatggggacattcaaatcaaaatctgatcactgacatatcaagcactgatccccataaatccataaatttaaaaaaaaaaaagcacaataaggaaacactcatttcaatggccacctcttctttgggccaaggtgcggcttgcaccactaccattgtcaacagacatccacagcaccctgcatgtactcatgtgcgtcatgaaaagcgacagccgagctctaagccttcccctgcactgtggctcctatggtctaaggggtcactgctcttcagaaggctcgcacataccccaagagttgtgttctgcttgttgtagccagcaaagtgaaggatgctctcagtggccatggccagccccgtgtgctgggacagtcccgatacccagttctgatgtttgttcagatattcctgaaataggaaaaacacatggggtttcagttatttatctgatttttttagaggcagggtctcgctctgtcacccaggctggagtgtggtggcacgatcatggctcattgcagcctcgacctcttagactcaagccatcctcccgcctcagcttcccaagtagctgggactataggggcacgccactatgcctggctaattttgcaattttttttgtagagatggtgtctcactatattgctcaggttggcttgaattcctgggctcaagtgatcctcccgcctcagcatcccaaaatgtcaggattacaggcatgagccactgtgcctggccttgctatttcatttaaaggggaaaataaaactttataaattaaggtgtgggcaaatggaccaaacactgggtttctgtcctgggtctgcccctccctaactagctgtgggactgtcagtaagtcaaagcccctctatgaccagctactgctcatttgactgaggacaaggccaattccccgagcggctgtcatgcagtcactgcggtgttgcaccgtcaatgggagagggccatttattctttcagcacatccttgctgagcatctgctgtggtagccaccaggcaaataagctacaaagccttggccttgcggtcaacaggcaggctgtgtggtgtggagcctcggttctctactgcagcataccagcagcctggtgtgggtgaactggacagcaggaacgaagaacaacacctgtgtccacctggccacccagtgggagaagggtgctgggcaatgggatacctggcagagcccaggggtgtgagggaggcctcctgctctggggaccacagggggctcagcctgcaggagtaccaaggacaagggtctcgagggtgggggcaagcctggaacagatgcaggccctgtttacaggcgtgaaccaactaattcccttaagaagaaatgtacaggagtatatacatgcagaattgtctcaatggttttgggggactcctggagctccagaaacccatccttggacactatgacgatgaagagtgactaataatcaagtttaaaagggaagtacactgaccagataccctattaaaaccagactactctggtgggtggaggagagggcagattcggggaaggctgaggctgggcacggagggtggggaataagcacactgcaggggaagtgaaagggcaggcctggggcacgccaaggggacacctggtggaaaaatcaagaccgcttcaagccttttcattttccatttccttcttaggccagacctgcgtgagaaagtaaaaagctctatcagctgctttttttgtccacttaaactttctaggcattagagggggcctcccctcttcagacgacagacagccttgggacctgaggcccttttgctgtaaatgaacaaagggaaatagtttcttgccactgcgtttccacacagctctcagggctcttggagctggctgctctatccttcctggactccacaaccagaaacacttttgagcctgtttcatctttaaagtgctgccagggtaaacctcacaagagttcctctcagcacacccactctctgctaacacagattccttccagaggtatttttctcatctttgattccttttaaggcaattctttcctctcacaccctgtggcattacatggtttacttcgtggccatctgagtttccaaaccagtgtttttgtctgaaagactcccatgcacctacatgtgcagcttatgtggagctttaatgggacacaagtccccaactctgcctctgctccaccagccttggtcaggcccctgcctttgggcacaggtgccagcaatgcacttggcacttagagatgctgccatctggcagcctcccacatccaccacacaagcccttcctctcgtgagcagcccccaagtcttgccacagacctggcacctcacctggtgtgagccgtcagatgccctccttgtgccctggccagcactggccccacaggcgctcctaacacacagagcagcctctgaggcatctattattctcaggccctagactgatgcttccagtctccattcacactagtgctatttggattttgagttcttcatgtctctgtaaagcttttttgggagtttgaaggagcttatggcaattgccttttgatggtttcaagtacctgcaggtgggacttggtgacggtaggtgcccacttcatggcctcctggaggatcatcccacagcgtgcagcgaagtccttcacaatgctctggaagagggtgaagctgcttctcaacaacccgaggtcagttcatctgagctgccgtagtgactgtcatgggctgaactatgtctccccaaatccctatgctgcgccttaactggtaccagtacctcagagtggaactcatttggagatagggctttaaagaggtgattcaattaaaaggctgatagggtaggtcctgatccaatctggccagtatccttccttacgtgtgtgcagaggaaatctggacacacagaaatactggggcagggaggagggtgtgcacagagggaagaacacgtaaagacacagggagaaggctgccattcacaagccaaggagagaggtctccacagaaaccagctctgccaacactttgattttacacttcggccctcagaactgtaagacaatcaatgtctgtcaagacctttcaagctgcccagtctattgtcttttgctacagaagcccaagagactagcacagccactaagtttgaacctcaaggcccctggggccaggaagcccacacacactatgatctgtatgtaattcctgcacaaggtttgtggcagaatctacaagaataacatgtcacagggacactgtgcaacttgtgtcctgggtctgggactggatggaagggcaggctctgcgtggcaaaatcctcttcggtgccacaccactctgtgggaaactccccattgacagctggtctggcagaggtccagaggtaggacatgactcagcccaggctgaaggagctgtgagctgagttgcagtcttgccacagtgagggctctgagaccgagttggggagaggagagacccagtacatcctcctcttttggagtgatttattctgccagtttccccattggatagcacaagtcaaaggcatgatcccctattaccacaataacaaaatgtcagtgcacctcagagaagtgaagtccacctgaaaatcatgcttgtgcgacgcagactcgagaggctataaactggctggtagctgaagacctctttggcagctaaaccgagaacacagctgagtcaacatggctgaggtgggggagctgggcttggaagacagagcgacctgggggcagccagctccccttgcactcggtggagcctggcaatggcttggtctcctcactgggggatggggccagcaccacccacacctcaaattgctggggactgggtgagctcatgcaggttgaccatctcgtggaaatactcagggaattgtggtaaagatggcccttagtgcaggggatcgtgtcgggcctacctcacgggcttcgtacgtgtcaggaaccgtgatccggtagggggcgtcggggatgtcatagtaaggctgatccttgtgaatatcctgcaagcacagcaagactccctcttccaaactgccttccccaagttgccactagcaaccacatgggccacccctacccaccacctgtctgtctgtgacaggcctccatacttgatgcaacttattgcaaaacaccaggtggatttgggccccctcacccccaactcgacacctgtagcattaattatgttcaggcttattgtcagagaagcatgccacaacacagggcggacagggccggcggggtggtggtagagcgggtggtgtttgggccctaggtctcctggggacactcacagcgctcagtgacagtgacagggtctgcaggatgtccagcatggtcttcagcacagtcccgctccagagcaagtggggaaacctgcaccaagagccagctctcaggaccaagagccaaacctccaaggaaggtctgcttctaggagccccctcagctgccagcccgagcccatatctgcttcaggccagctgaaggaggaggtcgggaggcccttgcagcaggatgcctggcctcctcaggctcattgcagtaaggtgagcaacgcctggtcagaaaggctccccaggcccctgccagccccacttcttagggccagacaaacctgacaccaactgccttggttatgcactggccaggacacccctcactttccaaagcaatcctcttagtttctgaccagggttctccattatttctcacataatggagaaaacaacagtatctacctgacaccctggggtaagacaggccatgggctccgatggccccagggctgaaggagaggtgtctctgcacagctgtgacccaccagtggcccactgctcaggaagcccagctcagacacacgccacgtgtgtgctggactcgttctcgtgacccctggctggctcctgaccacctgtggtggcgctgctgcctggaccaggcacacagtatctgcaacaggctccagaaccactggatacctctggggagctgcaggcagcctccatgtgggtgttttgctgcctctggccttctcaccttggagaagctggtccagcccacctgtgagagttctcatcagtgtggggacatgtcccaacagggtctgttttggctcccagaacaaagagtatacagcacagaagggtctgtgtgggcttttgttcctgagaagcccaaagatactgatcctaccaggggacctctggctgggccctgggctagaagatggtgcaccaggtcatgccagagtgggtgggactgagagacacagggatgtggcacccagcaaatgtgctgtaagtaacatcgatagctcagaatgaacagaagtttctgcaccaaaattcagactctgcaggaaactcacagacattggagggaggctgcatcacccttaggagttttcattctgactccattttttcctagattaataatataaggatgatttttcccagcatttgaaatcacagaagtttatatacatacacacaaaacattagcaggaaaatgagcttacttatccaccagaccagatagatacttgtctgccaccctccttatcctcttgtggatgtggttgaagttcaccaacaggaactgagcgtgccgctccagctcctcctcgttctccttggtcttggcctagagatgcaaaagaaacaggtaccgcagtgccccagatgcctccagcagacagacacgcattcatgctggagaggcttactttatccgccatcatgttcaggaaggcatcgaatactttgtccgcgactgcaatcacacactgcatcatccctgaaacgagaaggtttccatggataaggtgcagcaacagagagagaatcctagcaactttcaatcattttcttttgaaatgattttagacttacagagagtggcaaagacagcacagagctcccatatacccttcacctagcttccctggattttaacatctgcagtaaccaggctgatgtgtcaaaactgagtcagatattgatataatcctattacctaaacttcagacttcgtctggatttcccaggtctcccacacatgccccgcttctgttccagcatccaacccaggacaccaggtggcatttaatctgtgtctcctactcctgtccaatatgtggtgactcctcagtctgtcaatgtcttttgtgactttgacacttttgaagaacagttattttgttgaatgtcccctaatttaggtttgtctgatgcttgtccatgataagactagggttacaggatttgagggagaactccatagagtggatgtgccctttcttttttctttctcttttttttgagattgaatctcgttctgttgcccaggctggagtgtggtggcgcgatcttggctcactgcaacctccgcctcctgggttcacgccattctcctgcctcagcctcctgagcagctgagactacaggtgcccaccaccacgcccggctaattttttgtatttttagtagagacagggtttcaccacgttggccaggatggtcttgatctcctgacatcgtgatccgcccgcctcggcctcccaaagtgctgggattacaggcgtgagccaccgtgtccggcctggatgtgctctttctgcatcacgtaagtggtatgtgataacagtatctcttattactggtgaagctaaccttgatcccttggtttgagttaccgtttttccctttttctattttttttgagacagggtctcactttgttgcccagtctggagtgcaatggtgagatcatagctcagctgcaaccttgatctcccaggctcaagggatcctcccacctcagcctccctggtggctgggattacagatgtacaacaccatgctcagctaattgattattttttgtagagactgggagtctcactatgtagcccaggctggtcttgaactcctgggtcaagcaatccttctgcctcggcctcctaaagtgctaggattacaggcgtgagccactatgcccagtccctttctctattctttagaagcaagtcactaaggacagcccacactcagagccaaggaattaaatgctacctcctgaaggaaatttgtgaatgagaattacagccaccacagcgattgatattttggggaagatactttgaagttatgcagagatcatgtcttttaagattttgccccttcactttggcatccacgagtgaattctgcctgcagtagttactgtggttgtcataggaattttctatttccctcaattctttctactttttaaaaaatgttggccaggcatggtggctcacgcccataatcccagcactttgagaggccgaggtgggtggatcacgaggtcaggagttcgagaccagcctggccaacatggtgaaaccccatctttactaaaaatacaaaaattagccaggcatggtagcgtgccactgtaatcccagctacttgggaggctgaggcaggagaatcgcttgaccccaggagacagaggttgcagtgagctgagatcatgccactgcactccagcctgggtgacagagcgagactccatctcaaacaaaacaaaaatttattttttagggacagggtatcgctttgttgcctaggctggtcttgaactcctgggctcaagcaatcctcctgccttggcctcccaaaatgctaggattacaggcatgagccaccgtgcccagcctcttctatttttattaatagtaactggaattctgtaaggaaggttcagcctttttccccattttttatttattcggtagtctaatcattacagaaccgtggatgtttattcgttgggttataatccaataccatttattctattcaaatcattccagctttggccactcggagctctttcaggttggctcctgtgtcattcggacaggccccatgtcttgtcttttcttcttctttcttggcgtgtccttactttctggtgtaacaaggtgccccaggctcatcctgtacaggcctccctagaatcaaccatttctccatggagccctggttccttttattggagaatactatttagaaaccaagatctgagcaccggatatgctcattgttacagaggtgccaagtaggctgtaaaaggcaacagaatgggctgggcacagtggctcatgcctgtaatcccagcattttgggaggctgaggcgggtggatcacttgaggtcaggagtttgagaccagcctggccaacatggtgaaaccccgtctctactaaaaatacaaaaattagctgggcacggtggtgcacacctgttaattccagctacttgggaggctggggcatgagaatcacttgagcctgggaggtagaggttgcagggagctgagattgtgccactgcactctaggctgggtgacagagcgacacactgtcacataaaaaaaaaaaaaagaaaagaaaaagaaaaaaagcaacagaacacagtgatcatcacagtgcagatgaagaaactgtaataaaatgccaattcacactccataatgctgtttctctatccagtgtttttaatttgcatgactacatgctgggtctgccctctgcctccaggcagagagacaaggcaggtgctatcagcttggcacctcacacccagcatgaagcctgagacataaagaggcctttcatagctatctgttataagggtaagtgggaccgcagcaatttgaaaagttatcagtgtgacctggacagatgctcaagggtagtgagaggctgctttcttaagaggctgggttgggtgggtgaaatcttattttgggccatgtgtttagtataatagcttttttttttttttttaattttttgagacagagtttcgctcatcgcccaggctggagcgcagtggtgcgatctcagctcactgcaacctccgacgggttgcattcccagattcaagcaattctcctgtctcagcctcccgagtaggtgggattacaggcatgcgccaccatgcagggctaattttgtattttcagtagagatggggtttctccgtgttggtcaggctggtctcaaactcctgatctcaaatgatccacccgccttggcctcccaaagtgctgggattacaggcgtgagccaccacacctggcctagtataatagttttttcatatagttctttggaaactgaaactgtaaattcctgataatcagatagacatcagatgccaatcaatgtcatgtagtagcatctaaggagattaaaaaaaattttttttttgagacgtagtcttgctctgttgcccaggctggagcgcagtggtgtgatcttggctcactccaacctctgcctcccaggttcaagtgattctcctgcctcagcttcccaagtagctgggattacagtcacctgccatcacacccagctaatttttgtatttttagtagagatgggtttcatcatgttggccaggctggtctcaaactcctgacctcaagtgatctgcccacctcggctcccaaagtgctgagattacaggtgtgagctaccacacccggccctaaggtaagtaagatttttactttaaaaaggccactctcctcttaaccccttagtttagctctggattactggtgaactgactcacaggatggtgggcaggtgagcagcaggctcctgccctcacgttcctgtgcagctgagaacataacagaggctcatcttatacctgcagagaggaggcagaagtccccactttagtggggctgctagatatttcatataccctctcctcctggtaggttctgaaaattcaagaataatatatgtctccaaagacatttccttcttatctttcatgttttagaggaaaaatataagagggatatacactcaatagctgtacatttactggctaagtgccacgctcagaacaaaaataatcagtttgaaaccatgtggaagagtacaatgtactgcaaaaatgaaaatcgctttattttgaattaaggtgaggaggaacaatcagtcccccggaacaatttaacgtcctctgatgtcacaggaacagaaaaacagagctcagagagaagggcgaatgagacatctcacttcagaaagggatctgattcggtttatgaatattctctagaaggctggcaaaatctgctaggttctccttcctttttttttttgagatggagtttcactctgtctcccaggctggagtgtgtggtgtgatctcagctcactgcaacctctgcctcccaggttcaagtgattctcctgccttggcctcccaagtagccaggactacaggcacacgccaccgcacctggctaatttttgtatttttagtagagatggggtttcatcatgttggccaggctggtctcgaactcctgacatcaagtgatccacccacttcagcctcccagagtgctgggattacaggcgtgagctaccgcacccagcctttttcttcctttttttgtctcctcaggtcttgtctgaataatgtgctaggtgcttaattcttctagaggttggcagtttcaattttgttgttgcttagtctctctcctagaaccaaagaatcgcagggtgggccaattgtctagcacaagcttttccaatctgcagtccacacacagcccaggatggctttcaatgtggcccaacacaaatttgtaaacttaaacattatgagattctgggccgggcgcagtggctcatgcctgtaatccctgcactttgggaggccgaggcgggcggatcacgaggtcaggagatcgagaccattctggctaacacagtgaaaccccgtctctactaaaaatacaaaaaattagccaggcgtggtggtgggcgcctgtagtcccagctacttgggaggctgaggcaggagaatggcatgaacctgggaggcggagcttgcagtcagctgagatcgttccactgcactccagcttgggcaacagagcaagactctgtctcaaaaaaaaaaaaaaaaaaaaaaaaacatgagattctgtgtcttaaatgtcttaaaatattataagattttttgtgtgtgatttttctttcttttcttttttttttttttttttgctcattagctatcgttagtgttagtatgttttatgtgtggcccaagacaattctttttcttccaatgtggctcaaggaagccaaaaaattggacacccctggtctagcacaaaacttagcacaaaatctgctactacatggacaaatgcaaggtggacggatgaggggaacagatcaatgaacagttcagccagagcttgacagcatctctcttatagccccaactggtcctggggcatgtgtgtgagactctctgaatgtggcccccaccccgccctgtgtctacatcccctctggaagaggcttctctgtagaaactgcctgcctgcacctcccatccctggcctcaaatgggctccttgctcactccaatcccctccttactgccagaagggggagcttccagaaccctcacagtctttccttgccaactccactggctcccagctgcaaaaataaattcatgcacctgacttcctgactgttgtacagcagtgtgaagtgctccacaaaggacttactagaagagtcttacctgaagcagtatctcagagcccctggggcatttttttgtttgtttgttttttaagagacagggtcttgctccgtcacctaggctggagtgcagtggtgcgatcctggctcacttcaaccttgaactgggctcaagggatccccctgcctcagcccccagactagctaggacgacaggcatgttccaccatgcccagctaattatattttttgtacagatggggtattgctatgtagcccaggctggtcttaaactcctggcctcaagtaatccacttgggttggcctcccaaagtattgggattacaggcgtaagccactgcacctggcctggggtgatttttaaaaaacatttcttgaagcgttgatttttctttttcttttcttttctttttttttttttttttttttgagacagagtctctctgtcacccaggatggagtgctgaggcacgatctcggctcacctcaacctccgtctcccaggttcaagcaattctcctgcctcagcctccccagcagctgggactacaggcgtgcaccaccacgctcggcttatttatttatttttgagacagagtctcactctgtcaccaaggctggagtacagttgcgtgaactccactcactgcaagctccacctcccgggttcatgccattctcctgtctcagcctcccgagtagctgggactacaggcgcaggccaccacgcccggctaattttttgtatttttagtagagacagggtttcaccgtgttagccaggacggtcttgatctcctgaccttgtgatctgcctgcctcggcctctcaaagtgctgggattacaagtgtgagtcaccgcacccagccaatttttttatttttagtagagacggggtttcaccatgttggccaggctggtctcaaactcctgacctcaggtgatctacctgcctcagcttcccaaagtgctgggattacagctgtgagccactgtgcccagcctgatttttcaacaaaagaaaaaatggtacaagaagtatcggaaataatttctccataagcaagaacaagttgatagattcaccaacctatcaaaggcttctggtgcggaaaggactacacactgttagttgtacttcattaatactaaatttgtcaatctcaagaatttatcaataagcatgcctcaaagaatttattcatacagttaatcaaaatttgtggattctccccaattcccttgcatatttaaacatgatttcatcataattacaaaaattatcaaattattctaagcatttaattaaaacttaggtctaacatttcagcatattttaaatttttgattttaaacaccttataaatcagacttcttagtgcccttacactaaaactggccaaaaagtgcttatacgcagcatttaactttttcctttgttgtctctattttaatatctttttattggctaaatacacttttgtaaaactaatattagccttttgcaatttaaaaaaattaaggtataatttgcatataataaaatccacaggtcttatgtgctcaattccatgacttaacaactgtacacactcacgggaccactacccaaacaatctagaggacacttccatcaatccagagggtctcctggtaaccttcccagtttccatctctcctttttattcttatcttagctttgtcttcatagggttttgatcattgtaacatttttatgccttcctacagtttccaccatttctctgtcttcccaggagttggtctcctgggctagggctggtaacagctgaggccctctgtgcactcagggtctgacgacaagttgcatctggaagcaagtggcatgatcatagctcactgcaatcttgaactcctgggctcaagcgatcctcccactcagcctcccaagtaacttgggactacaggcacaaactactgtttcctgctcctgacgtttaaaaaccatgactgctctctggcaacagcaagttgctgcaggtccatcagtgcccatccgaggagccctggtccctctagatgagtgctggagcacacttgagcatagatagtgggctagaatgaccatccttctgttcggggcccttgcaccagcagtagaaccattaaggcgtatatttgaaggctatatgttttatactgatctttctcatgcaatatttaacttcataaaacattttctacatgtagacagaaaagaggaagtagtacgcctttttaccctattaaagctcaattcatcatgaaagcaccataataatgagcttaccagatttgtctttctgaatagctttatcctcaaagtagcagaacattacctggaagcgatcaggatctgttgaacgcagtaccctaagaagaaaacagctttaaataaattttgaaaaatctgggccctccctatcacagatttgacactgcccataagtggtaaggatgtgaagaacatttgccctctgtcattcataagggtgcacactgaggtggactttttggagggtgaggtgcaccatctattatacattcccatatttttcactccagcagccccaccattaggatatatcttcagggttacatgcacaaggattctcctaacagcactgactgcattatccaaaatggaaagactctgaatgctcaccaacaggagactgggcagataagccaaagcatacccattcgatgacacatcatgcagccaccaaacgagaggcagctctctatgtgagctgttacaaaaaaagtctgagacatactattaacagaaaaaaggaaggtgcagggaacacatgtccagcatgaccccacttacaggtttcctaaaggtctgtctttgcatgtgtatgtgtaggctatgcatgcttgcctatgcacagaaaatttctagaggaaaattaagaggccattaacagtaggatagtagaaatgaagtattcacgtctacaaaagtgatacctgtattttttcatctttagtatcttctgtactattccagtgttttctcttctcttttttgttttatgcactctgtacatttttcttttatggtaaaaaaaatatctttaacctcagggggaaagggagaaaaaggaaaaagcgcatgcacttgtcccatgggtgctgtgaagggctgttcagagttccaggggctccactaaggcagcagcggctcggcaggccatgtcttttggcctctgcaccaacctgtcaagagttaagcctcaggagggcaggccaggtgactttcagcacacgcattcgagtgtgcacgtgcacacacctttaacttgatttcccaaattctccactttgtggttttaaagctctctcaatacccagtggctgggaacctgagccaggttcctgaataaaggctttgaggttgcctctctatgctaacagagtgctctcaagggcctggtaggcagcccgaggtggaaggtgggctcacaggagctgctatgggctgcgtcttagagtcttcctctgccagttaagagcccgtcctgagaacctgagaaaactactcaggggcatactcatgggaaaggcagaggtagctctgccttcaaaccacatgaggttgagagggtctggagatacctcttctagccgtacatgctgggatgaaagccatgtttttgctctgtttgggtctggcttgttttgttttggctgttttttctttgaaaatacattgtttagaaaaaagactacaaacagctatactaacaggctataggggatgacagtgaggtcagtgttttttctctctctacttattttgcaagattttgtataaatgttttgtttttataagacagggtcttttgcccaggctagagtgcagtggtttgatcatagctcactgcagcctcaacctcctaggcttaagcaacccccttgcctcagtctcctgagtagctgggactacaggcatgtgccaccacaactggctaggtttttttgcttttttttttggggggggggggggttagagacaagttcttgctctgttgcagaagctcaaaacttccgggctcaagtgatcctcccacccctcaaaatgctgggattagccatttgtttttttgagacagagtctcactctgtcgcccaggctgcagtgcagtggcaccatcttggctcactgcaacctccacctcctgggtcaagcaattctcctgcctcagcctcctcagtagctgggactacaggcatgcaccaccacatccagctaatttttatatttttagtagagacggggtttcaccatgttggtcagactggtctcgaactcctgacctcaggatctgcctgcctcggcctcccaaagtgttgggatgacaggagtgagccactgcaaccggccgtgcctagccatttttgtgcaatgttctttttttctttttttttttttgagacggagtctcgctctgtcgcccaggctggagtgcagtggcgcgatctcagctcactacaagctccacctcctgggttcatgccattctcctgcctcagcctcctgagtagctgggactataggcacccgccaccacatctggctaatttttgtatttttagtagagatggggtttcaccacgttggccaggctggtctcgaactactggcctcaggtgatccactcgccttggcctcctaaagtgctggggttacaggtgtgagccaccacatccagccaaaataaaagacacttacaatgaaaaaagaacaaagtcaacactcccttggctctgtgggacttggggagaatgcgtcactgatttccacatttggctgtgtgtggagccccgggctgagggcagggaggaggagactgagcaggagggtagggtgcattcccatgcaaccaaagcactctgcctttcttttatgtattgagctttcaaggactattttactagagggttggtggcaacaatgaaaggctaaaatagtgttttccaaatagcctttctctcaggaacactttctttttcaaatcatttgggaaagaaattattctacgacttatttgcatccctcccgacttaagctgagtgtaatttgaccttttcttgacaacaggaatcatcattttgtagccaatgtactcagctgctgtcccagggcgcctgaggcctcagcacagtgggtctgtatagcactgcctacctcacaagcatgtcggggagtgcgtaaacatgtgtaatgcagcacagtacctggtacagcacagacactcaatccaagcttacttctgaggtcaacatgataacagctgtagatcctaagtgtcactaccactgttaggactgctgtggccacagatgtgtcctgagcatcgggccacatgcaggactgttttggagccggccccaccccatgtcgcatttgctgtttgtactcaaccatggtcctgggaaacagctcagtgagtgtcctagacacgcactcagcgaggctgggtcctcagaagggcctcgctcagtccgtgggctgagttcacaacactgactgcaactgctcagaagcctgtttcctatcagagagaagatgatgcggagcttagatactgggaggtgttactatacgtggtgtctggtggtcatgaaggaggggcatacgagaaaagtagagggtgtttttgcttggtttttcagaaagtttgcatgtcttgggagaagttgaaaaaagtctcatgcttacgagggcacaaaaatgaaaaccctgctcaaatgtggatgtgcatgtgcatggtggtgaaggcacgtgtacctcatgtactccagccggtacacagagaggaggtaggtggacatggcgaagtccagcttgttgatgagtgcggacacctcgggaggggggtccagcaggttgatgatagtgctgcggagctcactcagctcagcctggagggagagaaacatccgagggctcatggggcatcccccaggacaaacaggtcccagtggctggcaacatgtgttaataatgacagtgaaaagatctgccctaattggcacagagagcatggtaaaaatgagatgtgaatccttacgggggtgaccgtgtcattcttcatggctgagttatactggaggacggaccgcagtggctccttgctgggaaaggtgagcaagggggacttagtggctatttcacagaccccctcgtaccattcttctggccagagtcctgcaataaagtgaacataaatgaggaaatcaccttggtcggaaagcactgcagtgaggttgactgacaatttctatagtcatgggtcctttgagacaattatcccaaaaactaggcacagaaacgaagtctgttacctgacttggacagacttttcctaaggtgtatggcattctcagcaccctaaactacatctggggacagtaacacttgctaatacttgcagaaagaagcagctgcatgtggactcatttaaacatgctcacattcataattacgtgggctctgacctcacctttaccttcactctgcactccgtcttcactgggagagagatgatccccctacctgagccctccacagcgaatcccatcagaacggaatacagccagaagtctcggaagagcttctgtaaccgaggcttagcttctttgatgggtggcagtcgtcgggtgagctgatgtgccaagaagagagggagaaaggaggttatttgctgaggaaaccctaagccctgtaggtgtaaaatcaaccacagattcattctctaagagcattctcagaaactcagactgggtaggaaaaggcacactgagcagtgatgattctgccaataagcattgtccatccactcatttactgagtccctagtgtgcaccaggtgctgtgccagggaggaaaaagccctgttcctgcacttgaaggacttcctgtctagtttggaggcaggtgagcaacagttacagtggggtggagttcccagagaaagtgtcatgggtctcagagttaacatttgaggaaaacttagccaggaaagaagagaaggcagcctgtccagccacaagagcattaggtcctaagcctggcactgtggagggtaacaaatgctcaggaaaggcaaacaatggatgcgagccagagcttgaggaagggatgccactggggaggcagggagagcacaagaactctcatgggccaggcagcacaaattttccaaacagtaatcttcggcagaatccccatatatgtaacaggtaaagcagagttgcttgggtgcaggtgaggggctattgtccttgtgttcctgctccaaatgctggggggaggcagggagagactcatcagtggtataaatggctaaacttggccaagcacggtggctcacgcctgtaatcccaacactttgggaggccgaggtgggcagatcacctgaggtcaggagttcaagaccagcctggccaacatggtgaaaccccatctctactaaaaatacaaaaaattagctgggcgtggtggcaggcacctgtaatcccagctactcgggagattgaggcaggagaactgcttgaacccaggagacagaggttgcagtgagccaagatcgcaccattgcactccagcctgggcaacaagggcgaaactccatctcaaaaaaccaaaaggtttaacttgtgcacgatgcccagctggacaggctgatccttacggaccccccagtggatgttgagctcccatcagtgatgttgagcctgtggtaagcgggggctttgctacccccaaacacttatgagcacctggtatgggccaggcactgggccgggagagaggtgggagagatgaagacaccatctcttgaggcaaggagggcacaatgggatgggctgtgacacatcatgcacagcaggcaggactgtaaactgtcacaacacttctttgaaagcaatttggtaatatgcatcagaaattctaaatatccccacatatttcacccaaaatcccatccctgagaaatctatccaaaaaatgttaaaaagctgatttaggcacaaaaatgttgcaacagcaaaataaatagaaacacactagatgtctacctgaaagggacatttaaataagtaatggtatattaaaagtataataaattggccgggcacagtggctcttgcctgtaatcccagcactttgggaggccgaggcaggtggatcacgaggtcaggagatcaagaccattctggctaacagggtgaaaccctgtctctactaaaaaatacaaaaacattagccgggcgtggtggcaggcgcctatagtcccagctactcaggaggctgaggcaggagaatggcgtgaacctgggaggttgagcttgcagtgagccaagatggcgctactgcactctagcctgggcgacagagcaagactctgtctcaaaaaaaaaaaaagtataataaattaattatttttgagatagggtctcactctgttacccaggctggagtgcagtggcacaatcatcactgcagcactgacctcgatctcccaggctcaagtgatcctcccacctcagccttcccagtagcagggaggacaggtgtgctccaccatgtccagctaattattattttatttatactttttgagatggagtcttgctctgtcgcccaggctggagtgccgaggcacaacctcagctcactgcaacctttgcctcccaggttaaagcaattctcctgcctcagcctcctgagtagctgggactacgggcatgcaccactatgctcagctaatttttgtatttttagtagagatgcggtttcaccatgttggccaggctggtctcaaactcctgacctcaagtgatctgcccgcctcagcctcctaaagtcctgggattacaggtgtgagccaccacacctggcctaattattattattattattattattattattattattattatttccaattcaaaaattttaatttaaaagtaaactttaatgtcaaaaatgcaaacttggggaggggagaaagatcacacgcaaagctgccacttcacacttgcagggctgcacggcagctaggcaaaggtgttcctcaattcccagacggtgcggcggccagacagaggtgctacttactcacttcccagatggggtggtggccaatgcccggcttaattattgtttttctttttttcatacaaacagacaccttactgactttttacatttttttgtagagaaaggctctcactatgttgcccagggtggtattaaactcctaggttcaagagatcctcccgtgttggcctccccaagtgttggaattacaggcgtgagccaccacactcagccaagaatcatattttctaagactatttggtgacacatgtagaactcacaatatgtcaagagaaaaaaatccaaaacgtataaataatatgatatagattttaaaaaatctaaatatatacatatagaacaaagatgggaaaaagcagccacatgttaagattatttctgggttgctagggatttcactcttcttctttaatgtctatatttcctggagctcttccatcaacatgttccttttacaatcaaagggagggtgcaggtgccggtccagggcttggcaacctgtgtggaagaaggctccacacctctgcttgagagccgccagggcactgtgtccttgggaagagtgggccaagacctgggggtgcagggcaggctctgggtaggtgctgaggaggtggggcactttggagagggctgtgtggagggcagcagcagacggaagcgacacagggcaggaaatctagagccacacaggatgtggccacaaaaggacagttgacaaggggcttccagttcagctagtggccaaggacagtgacagtaagaacacgcaactgtgggactgactgtctctgaagtgaccggcctcccaggataaggtcccaagtgatggtggagatatgaaggggtttccagactacagaattcaaggcctatgtggctaagaggttctggtaccttctaaagagaactagactttggtggttatggaaagggttgcgcttctagaatgcttccctctcaatgagaacagtagctccacgtggctgggaagttcaaagtggttttgacacagaaaagaggaagtaagtggactctatctttgatttgggatcctactcctgaccctgtgaacttcttggctccctcttgaggacgttggcttgaaagtggctctgtgggttctccctgctctctgacttctccgagcctgctggccactgtcttggctgagactgctctagtctccagaaaggagatctgctcactcctaagaagtatcaaggtcaggccaggtgtggtggctcacgcctgtaatcccagcactttgggaggccaagacaggcagatcaggaggtcaggagatcgagatcagcctggctaacacggtaaaaccccatctctactaaaaatacaaaaaattagccaggcgtggtggcacacacctgtagtcccaggtactcgggaggctgaagcaggagaatcgcttgaaaccaggaggccgaggttgcagtgagccaagattgcgccactgcactgcagcctgggcgacagagcgagacgccatttcaaaaaaaaaaaaaaatcaaggtcaggggggaagtgggaagactgaaatagataaaggattctaaagagatataacagtcaaatgcgacacatgaaaccctgaccagataaaaattaaaaacccataaaatacatgtttgaagtcatagagtaatctgacttggactagacatgtgatatatgtgaggcttgtgatcttcccaggagtgatggtagcacagcacagggcagagacccgtccatggaagaaacactggtgctagtgcccagggcagaagtgagtgatgtctttaagtggatatggaaaaatattaactattctacctaggttgtgggtgtatggatatttagtattcaattattccaatttctctgtgtatgtatacatattttttttagagacagggtctcactctgtcgaccacactggagtagggggtacaatcatagctcactgtacatactcaagtgatccttctgcctcagcctcctgagcagatgggactacaggtgtgcagcatcatggcccagtttttttttttttggtagagatgggttttgctagccgggagcagtggctcatgcctgtaatcctagcactttgggaggctgaggcgggcagatcatctgaggtcaggagttcaagaccagcctgggcaacatggtaaaaccctgtctctactaaaaacacaaaaattagccaggcatgatggcaggcgcctgtaatcccagctacttgggaggctgaggcaggagaatcgcttgaacccaggaggcagaggttgcagcaagctaagattgagccactgcactccagcctgggcaacagagcaaaaactccgtctcaaaaaaaaaaaaaaaaaaagagagagagagagatcggttttgctatgttgcccaagctggacacggacacacacacacacacacacacacacacacacacacacacacacacacacacaagctggacacagagacacacacagtgacagggcaaaggttccaaaattttaaacctggtaaatctgggtacgggtatacaggagttgttctactacactattctttcaacttttttgaaagtttgaagttatttcaaaagaaaaagttttccaaactttagtgatcctcctgcctcagcctcccaaagtgctgggatgataggcatgagccaccgtgcctgacccctctgtatatttttagaatttcatgttaaaagatggaaaagtctggatgaggtagttcacgcctgtcttcccagctctttgggaggccaaggtgggaagactgcttgaagccagacgttcaagaccaacttggccaacatagtgagaccccgcttttttctaactaaaaaaatttttttccaagttggaaaaaatatctagccataagacaaaccttgaaactgcaaaagaacaatggagtatgtgtgacaggaggtactgctctacagtggggttaaagccatacacaagctgtggtggctcacgcctgtaatcccagcactttgggaggccgatgcgggcggatcatgaggttaggagttcaagaccagcctggccagcatggtgaaacccgtctctactaaaaatacaaaacattagccagacgtggtggtgggcacctgtagtcccagctactagggaggctgaggcaggagaatggcgtgaacccaggaggcggagcttgcagtgagctgagattgcgccactgcactccagcctgggcgacagagcgagactctgtctcaaaaaaaaaaaagccatacacaagctgttaccactaaatgggaaaatgactgaaaaatgtcaatgtcaagagggactgaaatcaaatttttccaatagtgggttacatgatcagaaatccaaatagacaggaaatatgttggctttatttatttatttatttatttatttatttatttagacagagtctcactctgtcacccaggctggagtacagtggcatgaactcggctcactgcaaccttcacctcccaggttcaagcgattgtcctgcctcagcctcccgagtagctgggactacagatgtgtgccaccacacccagctaatttttgtatttttagtagggacggggttttaccatgttggtcaggctggtcttgaactcctgacctcaagtgatccacccgccttggcctctcaaagtgctgggattacaggtgtgagccaccacacctggccggtactggctttaaaaataacaaaagtaatacatacacatagaaaaaggtcaaacaaagaagtacatagaatgaaaaatgaatgctgtgtcccctcccagaccatttctgtgaataaatatgtaataccatgaaatgatgaggactaacattttctgaatgccaggcaccactctatgtgctttccacacattcattaacctcatttaattttctcatttaattaatgagataaattaatgtatctcatttaattttcacaacaacctcatgcagtaggtgtaactgtcaccctcatttcagagagcagaatactgagagctggaggccaaggggcaatttcagccagggtggctggtgacgcctcggtgaaaccaagagcgaacagtgagagcagcggccacctgctggtctgcagggatggtgtcctgggcagaaagaatagcaagtgccagggctgtgctggggccgggctttgcatgtgtgagaacaagacagagaatgagggaggtgggcccacgaggagtgtgggcacagacagcagcctctgcctgtggtgccacgctgaagactcagtattgtatgtgacagatgaaggctctaagaagacagctctgacaaaagctagagtgcaaaatcagactcagacacaaccaccggtctgtgtcctgaacacaatggacctttacactctggaatttctcaaacggagcaatgcacagacacccccatgggccccttgcacacccgcagattctcctaggagtcacattctctcttcagatagactctgggtgccgacactcccaaacatgctcttgaggagcagtctctgtgataagctgatcttccagacaatccagaatattcttaaaactttttagatcataaaatttaaaacacaaattaaaaaacaaattatcataaggccgggcacagtgactcatgcctgtaatcccagcactttgcaaggctgaagcaggaggatcacttgagcccaagagttcaagaccagcctaggcaacatagtgagaccctgtctctacaaaaaagtcaaaagttagctagacatggtggtgtgcacctgtattcccagctacttgcagggctgaggtgaggaggattgcttcagctcgggaggttgaggctgcagtgagccaagatcacgccactgcactccagcctgggtaacagagtgagaccctgtctcaaaaaacacatagggccaggcgtggtggctcacgcatgtaatcccagcactttgggaggccgagacgggaggatcacttcactccaggagttcaacaccagcctggccaacatagtgaaaccccgtctctactaaaaatacaaaaaattagttggacatggtggtgtgcgcctgtaatctcagccactcaggaggctgaggcaggagaacgcttgaacttgggagacagaggttgcagtgagctgagatcgcaccactgcactccagcatgggcagcagcgcgaaactctgtctcaaaacaaacaaacaaacaaacaaacacccataaacacaaaatgtatcacagcctcagagatccccacgaatgcctaagtggccctgaatttgggaggcactgctcagtaatagtcctatctgtcccacaacagacaggagtgctgggctgcacctactggcaacaaacacagcaacccttgactgaagaaaggtccatgccacaatccccttattctgtaagccactaattttgtcctctctcctccacctttcactgaggaacgagctcttggaaggacagggacacccgcctagtagctgagccagccacatcagtcctggagagcaggtggagggcagatgctgtgatcatcccagaagagaggacacagttggaggcagatgcatggtctctactttcagctaccctcaatgcagcctggtccccagaggcctgaagagcgccttgtttatgtggtgacctcaagaggggctgctcctgcaccaaggctatgtgtgcatgctaacacagtaaccgtcatatactcaaagtgtcagctctaagaactggagatgaggagctgcaagccactctacagttatcaaaggcacagctgagggggtttgtgctgaccaagctggttgcctggtgtttggattgggacttatttactttggaaaatatgcagcaacagcccagcaccaaagttcacatcaaaatcccactgatgaccttggctgctttcatctctgaagcgccacttctcagaaacacagaggtaagttgggtttctaatgtttctgctgattataaattatttttggtgtttacggataggcaactggttcatttttctagcaaactaagaattcagaagctttctacactgttttagaagtgggaaatggtttcatttttcagtgtgcctattataaaattgtgtcagttccattgttgggagagttgacaaacttagaataggagctgtggaatagatgaaaatattgtacttatattaaattaatcgaattggataactgtcctgtgattatgtatgagaatatccttgctcttgggtattttccctgaagtattagtattaaaggttagaggggccgggtgcagtggctcacgcctgtaatcccaacactttgggaggccgaggcgggtggatcacgaggtcaggagttcaagaccagcctgaccaacatggtgaagccaagtctctactaaaaatacaaaaattagctgggcgtggtggcacgcgcctgtaatcccagctactcaggaggctgaggcaggagaatcgcttaaacccgggaggcagaggttgcagtgagcggagatcgtgccactgcactccagcctggacaacagagttagactccgtcaaaaaaaaaaaaaaaaagaagaaaaaagaaaaaatgttagaggaacaagatataggagacctactctcaaatggtctagaagaaaaaatgtgtatgtgcatgcctgtgagaacacacacgtacgtacacacacacacagataatgacagggcaaaggttccaaaattttaaacctggtaaatctcggtacgggtatacaggagttgttctactacactattctttcaacatttttggaagtttgaacttacttcaaaataaaaagttttccaaactttaggcagttacttctctcccattctgcctgctctgttgggcctggagaccatacaccaggagggatgacggtttatcaagtgttatgctctgatgcgtgactgaaaaggccaacccagctctggcaattagcaagaaagcacaatatgaagttcccaggaaaaaaaaaaagcaaaacaaacttttgaatgatttatctttaaaatatattgtttctcttcaaacagtaatctggatttaatcacaacctagtgatagtttttaaacgtcttctacaatgtttgttatactaaatagcaaaacatcaggaagatttaccttcagatctttaatttcaatccataaaagatatcagagatattttctccttcctctggtaagggaatgacgaaaactatttttggctttttatcagataatgtgggaacagggtataagaagtttccaaatataacttctgaataccgggataaaacatgcatgtctttactctgccactctatctggcctcagatacgttttcctgaatgcttatttattcaagttggtttttgttttgttctttaaccttatttttatctgagaagaaaacattttccccctttgttccttcttcttttggctttcttttttaaaatagagatgaggtcttgctatgttgctccagctggtcttgaactcctgggctcaagcgatcctcctgccttggcctcccaagatgctaagattacaggtgtgagcccctatgcctggtcttcttcttcttgatcttagccaaaaggccaagaagtgataagaggaggacacttgaagtgtagttgggcaaggagccttctaccagctgcttactttctttgttcctgacttttaaaagtgtgttgctattgatacacagtctcctgatatgtaaaatgctgggaggatgaagctaagttactcaaagtgccattcagaaactgggcccagttctatttgcagctacatacattagaaatcatttctagaggctgagcatggtaactcatacctgtaattccagcactttgggaggccaaggcaggagaattgcctgagctcaggagtttgagacctgtctgggcaacatggtaaaaccccatctttaccaaaaacacaaaaaattaactgggtttggtggcacacacctgtggtcccagctacttcaaaaggctgaggtgggagggtctcttgagcctgagaggaacaggtggcagtgaaccaatattgtgccactgcactccagcctgggtgacagagtgagaccccgccgtctcaaaataaaaataaaaagaaatcgtttctagaaactgttttcccgtgtgtaaactagtggcactgcagcctgaggcaggtgctgagatggggacctggaaaaggcaacaggcattttgagtcagaaacaatgtgactttcctgctccaaaatgtgcaattcaaaagtctttcttagttgtgactaaaacaaactttgaacttactatttcaacagtattataaggggaagacccaaggaatgggactggcactgggaaaacagctaggaagctgctctgcacggccagggagtctggaagcatcctggtactccagagcgaacaaggctgagcgcttgatgtggggcttagaggcttaaccaacttggttcgaatctagccactgccacttattagtgacagtgacgaaaggctcagtctcctgatatataaaatgttgggaggatgaaactaagttacacgaagtgccttatacagcgtgtcaggcatccaacagaggccattatcaacattaaccacactgacagcatttcaagcagagtatccgaacagttaccccatcttcaggcctactgagttcaaatatttgcttaacaagagcagccagtaactcttacctggcctcaactggcagcagatattctgggcctcaaatatctatctaataggaaatggtcacagacacaaaataagcttaacaaaaggcagtttttttttgttttttttttgttttctgttttttgagataaggactcactctatcccccaggttggagtgcagtagtggcgtgatcacggctcactgcagactcaagtgatcctcctacttcagcctctcaagtagatgggaccacaggcgtgtgccatcacaccaggctaattatttttcttttcttttttttttttttgagacggagtttcgctctttttgcccaggctggagtgcaatggtgcgatcttggctcaccacaacctctgcctcctgaattcaaacgaatctcctgcctcagcctcctaagtatctgggattacaggcatgcgccaccacgccggctaatttttttgtattttttgtagagacagggtttctccatgttggccaggctggtctcgaactcccgacctcagatgatccgcccacctcggcctcccaaagtgctgggattactgacctgagccaccgcacccagcctatttatttaatttttcacagagatgaggtcttgctatgttgcccacactggtcttgagctcctgggctcaagtgatcttcctgccttggtctcccagtgttgggattataggcgtaagccacagcgcctggccggcagttctttctggggtgattagaagttgggaccatgtattacctgtctgagtcagcattataaacacctatggtcactgtcctggcaaaacatggaatcatcaaagctcatctaaccagagtgcagttaataaccaggaagtaagcaagagaaagacaaaggatttggcagtcaaaacagatttgacaggccaagtcagatcctcctctgaacgagtcagaggaacaaataaagacaggattgccataatgcctctgtgctaaaagcttatcttgtttacttaaataaagggagtgcccctcaggtcttgagtaagagcttgctgacatcaccctcacacagactttatctcttgtttctaaccctgtgttagaagcagtaacacagaagatttagttgctcctgacagcagtgggagctattgtctaagagatacaaaggagaaaaaagtatacctgcagcaagtgatatcacctctggggctgccaccacatcacctcactacgccctgagggggtctcagcactagacaagttccaaatcttttgcaaattaaacaaccccaggtcaggcgtggtggcttatgcctgtaatcccagcactttggggggctgaggtgggtggatcacctgaggtcaggagtttgagaccagcctggccaacagagcaaaaccccatctctactaaacaaaatacaaaaattaaccaggcgtagtggtgtgcacctgtagtcccagctacttgggaggctgaggcaagagaattgcttgagtccaggaggccgaagttgcagtaagccgagatcgcgccactgcactccagcctgggtgacagagtgagactccatttcaaaaaataaaaacaacaaaagccaattacaacaacaacaacaaaaaaacaacgaattaaacaaccccaaagattgcacaaatttcaagtatctttagaatatgttttcagaaagcctggcccatggacatttttcaacagcatctccattgcaaaggtggaatggtgtgagtcacacaggcatggctgagtcccactaatgcacatcccttctaggtactctccaatcaccagccccaggtgcccactcaagcccagctcttagtgaggtttccctgactctctgggcacttccactcctaccacacagggtagagccacacccctttccgtacccccatgtgctctggcagcattattttgagagccttcgctttactgcacgtctgtcccatctgtcccctgactggtccatgagcccctggtgggaactttgtctctggtaactaaacactgtctggaggtggtggacaaggtgtctggagaaaaacaaactcctccctgggatgcctgagctcccaggattctagaaggttagttttgcaaacctttaaagaagggattttcatcaaggggcccacagatccttcattgaggtttatgagtcccacatcaaaggttgggtgtctatctacatcagattctcttaaagtccatgatcctaaaacagttaagaactaatgctgtgagggcctcttcctgggtcaaagccacagggaacctgccatgtggatgctgcagcggggtgtggatcagccaggccgcctttcactgtgttctgttttccctcccagctttagctccgccaaaatgaaacactcattaaacgcacttctcattttcctcatcataacatctgcgtggggtgggagcaaaggcccgctggatcagctagagaaaggaggggaaactgctcagtctgcagatccccagtgggagcagttaaataacaaaaacctgagcatgcctcttctccctgccgacttccacaaggaaaacaccgtcaccaacgactggattccagagggggaggaggacgacgactatctggacctggagaagatattcagtgaagacgacgactacatcgacatcgtcgacagtctgtcagtttccccgacagactctgatgtgagtgctgggaacatcctccagctttttcatggcaagagccggatccagcgtcttaacatcctcaacgccaagttcgctttcaacctctaccgagtgctgaaagaccaggtcaacactttcgataacatcttcatagcacccgttggcatttctactgcgatgggtatgatttccttaggtctgaagggagagacccatgaacaagtgcactcgattttgcattttaaagactttgttaatgccagcagcaagtatgaaatcacgaccattcataatctcttccgtaagctgactcatcgcctcttcaggaggaattttgggtacacactgcggtcagtcaatgacctttatatccagaagcagtttccaatcctgcttgacttcaaaactaaagtaagagagtattactttgctgaggcccagatagctgacttctcagaccctgccttcatatcaaaaaccaacaaccacatcatgaagctcaccaagggcctcataaaagatgctctggagaatatagaccctgctacccagatgatgattctcaactgcatctacttcaaaggtaagaggcacctttacagttctcacagcaaacccacaacatactatttttgtatgtgggtagattgaatgccaagaactgtactgtagctataatttatccaggaaaactagacacaagattgactctggaacggggacagggaaggccaagctgaagtgacagtagcatctgacacttactgagccctaactctgtgctttaacacagccttgtgaggtcatcactgttattagcatccccattttacagaggaagccaccaacacatgaagtaaaaggatgggctgggcgcggtggctcacgcctgtaatcccagcactttgggaggccgaggcaggcagatcacttgaggtcaggagttcgagatcagcctgaccaacagaccaacatggtgaaaacctggctctactaaaaatacaaaaattagctgggcctggcggtgggtgcctgtactcccagctacttgggaggctgaggcaggagaatcacttgaacctggaaggcagagattgcagtgagccgagactgtgccactgcactctagcctggacgacagagtgagactccatctcaaaaaaaaaaaaaaaagaagtaaaacgatgctccaagggcacccagttattaaggggcagagccaaagctgaacccagggaggccaaccctagcaatctgttaaattggaagaaataatacaaaaactgttttagcatttggccagcctggatttgagttttctcttttcctttcccaattatcaataagcaggaatatagacaaaaggctaaagaaatgcacctgtgaactattcagcttgagcagctgacattgacacctacaagtgcttttcaggatacttttgaactactgggcaggtgggatggagaaataaattactatttccccagcaactgttctgggctgagcacaagggcactttttaaggaggtcaccccacacccatcacacacacataggacccctggaatcctaggaataaataagcatggatttgtaaaatccaaacctctcttttcaaatatcctcacctggaccagaccagaagaaacctctactttactctctaagctgagagtgtggaaggggaaacacgaggaatggttcggcttcaggactaattgcggtgacacacaaccacttctctttgccaccaaggactaccaggtacctgcaaagggcagtacttggaggccagtgctttctgctagttagctcccgtggttttatagcagcccaggcgaaggaaggagaccccccccagctcctggcttctgttcagggaaagggggccagagcccctcctgatctgtccacacacctgctctgtgccttggctgaggcccctgcagctctacaaggcaggcattctgctggataggccaagcagggtcactctgacacccaggtttccaccccaaggcatggcacaatgctggcctcctgtgggtggaatcaaaggctgagttctaacaggcttgcggcagacacacacacagagaccacatgtacatgatgaacacacatatccttttcattacaggttattagtacaagttttggaattgagcaaacaagagtctaagcgctggtttcaccacttctcgtttgtgtgacctcagacaagtcattcaacatctctatgactcagtttccttatctttatcacagagatgacacccactctgacagggccgagggaagaaccataagcgatggcaatgcaacagagtggcacatgacaagagctcagcgaatttgagggaatgaaactgtagattacaatactagtacaatatgataaacatatgatattgttagtgacatttattttacttctactagcaaataacctatgtttaggactgactttagaacaggctggcagaagcatttttggcagcatcaaagtcctccaacctactggtctgttggagccccccaagtacaccaaagagcctctgcattagccctggctgagggttcagggacaggcagagaagtacagcagtgagccatccctgcctgcatggaggtggagaaatgatcaggcatggtcagttgacaatctcctaaacacagtaacccgtgtcataccacagtgtaaacacacgtgcaaatgcttctgcttcctttccccatcatgagaatagtcactcaatgccgggcatcacaagggatcaaatgctaggagtacccaatcattcatggatgcttctcaaaggggacgagtgtctagaagtgtaattttaatttcacttaatttcatatggaatcatctccattactaattttgttctaattttaatgtgataatcactttgtaaagcacaataaacagaggcaggctctcatgaggaagtcagaaggaaagaatcccaagagacatgggacagctccatccaaactgaaagggccgtgattcccaaaagagcaattttgtccccaaggtctgaagacacttttggttgtcacaacctggggggttggagtaagcattactggtatctagaagggggaggctggggatgttgctaaacaccctaccatgcacagggcagcccacattgccacaaactattatgtggcccaaatgtcaaaaatgctgaggttgagaaaccctgggtgaggcagactcagggagaagggaatcgagcttcactcacaggcaggcaggagctgtctggtacttcaacctccaagacacctcctgctcatctcatcctggctgctctacccaccagctagaaaccttgaacaagttacttcacttctttgtgcctctgtttcctcatatgtaaaagagggataacaaaacgcacacaacttgcatgttgctaggagcagaaatgagataatacaggaaaggtgctgagaagaatgcccggcacatggccagttctcaactactagtcacccattactattagttactcacatcttagagctaacatagacatgggcttattcctggatacacagcactgtccccatatctacagtggtgatcctaagggcaacatggcatcacccaaatgtcttgttagtcactacagaatcacagtgtgagggatgaaggccatcaagacagagctgaggctggcagggtggctcatgcctataatcccagtgctttggaaggctgaggcaggaggattgcttgaggccaagggtttgagaccagcctaggtaacatagcaagaccccatctacaattaaaaaaaaaaaaaaaaagacagaaagaaaaaatagccaggcgtggcatgtgcttgtagtccaagctactggggagggaggctgaggcagaaggattccttgagcctgggagtgtgaggctgcagtgagctatgatggcatcgccgcactccagcctgcatgacacagtgagacctggtctcaaaaaccaaataataataacagtaataaaagctggaaagagctcaaagttactcatttgacagatgtgacagatgaagaaatagaagcgagttaggtgccttaccatggtcaaacaactagttcgtatcagaccctactccagaaactattccagtccgggtaacctctcgttaacctctcttgttagaaatgcaaatttctgcccaaatcaggcctcaggaatcaagagactgtggggtcggctctgcaggctatctgaatgaggcctccagggaaatcagattcactctcaagggtgagacgatttccctaaaggaaccttctcataacagcctcttcctgtggcctttacaggatcctgggtgaataaattcccagtggaaatgacacacaaccacaacttccggctgaatgagagagaggtagttaaggtttccatgatgcagaccaaggggaacttcctcgcagcaaatgaccaggagctggactgcgacatcctccagctggaatacgtggggggcatcagcatgctaattgtggtcccacacaagatgtctgggatgaagaccctcgaagcgcaactgacaccccgggtggtggagagatggcaaaaaagcatgacaaacaggtatttcacactgtgtgtttgttcttttgagctcccagatgctgggggtgtctgggaatactggaaaatggatcatttttttaaaaagggagaattatgtacaagtacccaagaacttccatacagggccactctgttaattcagccccaatttgttgcttgagataagagatgattagagagcattcataagggacacatctgccctctaggggccagtttcagaagttagaggcagatgacttagagacagcttggtgcttgctttgtggcttcgagtcccagcttcatcatccctaaaatgggtataattccattacttccccgggtcacttgagaaaataacagaatcagcgatgctgagcgcccctcccagtacttggaacctaggaggcactcaaaaaaagattggctcaactcttccctgcccaggaaattccaaggtcctcttagcctaccgaggacacatcattcatgatttcctctattattattcgttactttgtagttaaaactgcaggtgttaagtacttattgagattattattgggtcatggcagaaagaatggagaggtcttatttctgtcttactggatactggctaggcccatatgaagaagtgattctggtttgaacctccttataggacaagaatacaaacatatgcaaccaaactgagaaaagtaggctctcagaggaaggtatttgcccgggtagccagtcatcatgctctgtgaatttttccttaacaacgtcccttctgtacctgcctccttccattcctccctgcagcccggcagctcttgagaaagggactgcatcttttttttttttttttttttgagacagggtcttgttctgtcacccaggctggagtgcagtggcatcatcatggctcactgcagcctcaacctcctgaacttaagtgatcctctcacctcagcctcctgaatagttgagactacaggcgtgcaccttcatgcccagctaattaaactttttttggtagagatgaggtctcgctgtgttgcccaggctggtcttgaactcctggcctcaagcagtcctcctgccttggccttccaaagtgctgggattaacaggcgtgagccgctgtgcctggcccatttgacttttaattgagatcttacttggtgcaaggtatgagctaggtaaaagagtgaagaagatcaagccttcctgcccatccagctgggattgcaccttaaatctctttatcccctgcaaagtgccagactaactccacaggcactactgttgctatccgcccccttagggattgagtaagttgaggcaaagattgagaatattcagcattgtctagtatatacaggaaaggttctttttaaaagtacactaccagatattcgactccttaattacaaaaaaaaaaccaaatgcctaaaattgggaaaccaaaccagagaattattttagatgcctttttaaaccataaaccaggaaaagttctgctgctaaccttgaagataggaaacgaaccatacagtctcaaggaaataatcatgcaacagaaaacacacctcagttttcagtagcggaattacaaaggagtgtgcttcctaaaatcctcaactgacagtcccggaatataaattttaataagtgctatatcaattctgtgataaatataacccgtggccctttaaagggaaaatcatgattcttttgtaacttgtggttcaataaaactgggcccccctttccttttctgtctagaactcgagaagtgcttctgccgaaattcaagctggagaagaactacaatctagtggagtccctgaagttgatggggatcaggatgctgtttgacaaaaatggcaacatggcaggcatctcagaccaaaggatcgccatcgacctggtaaccactcccttgtccacccccgacccgtccccagggtctgcctcagcacagccccacctccacttgcccttcctacccaccccccaatctcatgtcccagcttggggtgctgagtctgctcttcggcctgggtgggatacacagaatgcctagtttcatggatgccagctggagagcacggcacctggcagacacttactgggcaggggggatcccaagagcagccatggggtgagccccactcccgctgacaccagagacaggggagacatgtgctgcggtctgggaaatagctacccccagccaaatcatgaaagagccattaaacaccgcactatacacatacttaacttaaaccaatcgggcgctcagcaaaagagagagaacaccagtccaaacagtgcagcagacccagttccccatcccggagaagtgcgcagcagtgtggggagctggagctggggtggctgtcctgcaccagcccccacgaccctcagaccacaggcactgccaagagggaacatgaacctagccggcctctaagtgcaacggctgcccctgacaggtggtgacagatattttcaagagtgactctgaccagctgtgatttccaccttacatgttgtctttggatcctttccctgaatgatatgagattgtgctgggaactctagccctctgtgtgctgacctccagaatctgacaactttcctttccaaacagttcaagcaccaaggcacgatcacagtgaacgaggaaggcacccaagccaccactgtgaccacggtggggttcatgccgctgtccacccaagtccgcttcactgtcgaccgcccctttcttttcctcatctacgagcatcgcaccagctgcctgctcttcatgggaagagtggccaaccccagcaggtcctagaggtggaggtctaggtgtctgaagtgccttgggggcaccctcattttgtttccattccaacaacgagaacagagatgttctggcatcatttacgtagtttacgctaccaatctgaattcgaggcccatatgagaggagcttagaaacgaccaagaagagaggcttgttggaatcaattctgcacaatagcccatgctgtaagctcatagaagtcactgtaactgtagtgtgtctgctgttacctagagggtctcacctccccactcttcacagcaaacctgagcagcgcgtcctaagcacctcccgctccggtgaccccatccttgcacacctgactctgtcactcaagcctttctccaccaggcccctcatctgaataccaagcacagaaatgagtggtgtgactaattccttacctctcccaaggagggtacacaactagcaccattcttgatgtccagggaagaagccacctcaagacatatgaggggtgccctgggctaatgttagggcttaattttctcaaagcctgacctttcaaatccatgatgaatgccatcagtccctcctgctgttgcctccctgtgacctggaggacagtgtgtgccatgtctcccatactagagataaataaatgtagccacatttactgtgtatctgttataattctctattttttgaagctcaaatatcaaaagccaaatccaaattcctggataactccaggtatgataaaggctgagaggaagtcacttgagcaccacaatgtgccacagcagggcatgttctcaggacaggacaggtgtgtgctgaatcctggggagggtctgtgcagtaccccagaactgtggggtgctaagtggcacacaagccccagggctcccacagtctatgccaggctgctgcagctttcatccctcatacctggtcctgcagtgggtctggtttgacagagcagatgacacctgaggaatatgtttctggatccttcaatccctgggtaagacaagtgaaatccacagaggctgttcagcacgcaagagtgccagtgctctttcagtgaggggatgactgacggtcacaggtgctgtgtgtgcaggtgtctaactgtaacccccacagcctggcagatgaggaagacaagggttggaagagttctgaaacctgtccaagatgctgaagtagtggggctgggttcaagtgcaggttggctggactccagggaccacacaaggagtcctgtcacaggcttctgaccccatgagaccaataccagtaagaagagtggtaaaagggagtagggacggaaggggaacgtcactgccctttgtaggcatgcctgtgggttatctcacagagtctccttaccctcaatccctagggggctggcactgttacccctcctttttacagctgcagaagcaatttcagctcacagaagggaaggcctctgcctgaggcctgaatccacacccaggcagggggaccctgcagccctgctttcccctgctcccttcctgacttcccacactgggctctgcctccttactctgctgagagcagatggtgcaggggctggatgaattgccccaagccatcctctcggcttcctggtgaaccctgatgctgcggatggcccactccttcaattcattctccaatctgcttcacccctcttcttttctgtcattctccaaactgcttcaccactcttcttttctgtcattctccaacctgcttcaccactcttcttttctggtgcctgtcctatatttctcatcttgctgcagcttccttttggctcttctcatttctaaatgtaataatctcaaaaaacccttttagtcctttgccatgtctgtcccatacccagaaaggcagtggtcacttctgctcacccagcgccctctctgctacagccggtgtggagtcctccacactcttgagcatccagacacccccgtttcaatgccttttgttcatgtacacccactcagaatctctcagatcccctcttacagaaactagcccatctgttactcaaagcaggagagtactcattcagaacacaggctctgagccaggctgcctggtttgaatcctggctctgccatctagtagctatgaaactctagtagcaggttctgtgcctcagtatcctcatctgtaaaatggggagaccagcagcacttaccttgagggattgctgtgaggattaatcaaattaatgtctagaaagcatttatttatttatttatttattcatttattttatttttttgagacggagtctcgctctgttgcccaggctggagtgcaatggcacaatcctggctcactgcaacctccgcctcctgggttcaagcaattctcctgcctaagcctcccgagtagctgggactacaggcacgtgccaccacgcttggctaatttttgtatttttagcagagatgaggtttcaccatgttggacaggctggtctcgaactcctgacctcaggtgatctgcccaccttggcctcccaaagtgttgggattacaggtgtaagccaccatgcctggtctggaaagcatttagatcactgcttggttttagcaagaactaggaaaggttgtcacattattctcaatctaagagagtacataagccaggccttcttaactggggagccttgggtagattgcttccatttaacttcctgaggttacatgcaaaatcttgagagtaataaggatttccatggacagagagtgcacagttttcgaaaaggttctctgtgacctaaaacatgttaatccacacacacctggttttgcaggcactgagaaaataagtaaaccttccaaggccacaaaagtgactggtgacacaagtaaacttgctctcagtgaaatacatgaatgtttttccagaaggaggtgcatcttattaaatcactattatatgacagtggaacaactaagtctctaagcattagataccattcaaaacgtttaactaacaagctaagtaacaactgaagtaatttaatcaatgatatctctgaagaaatattattcacaaagttgcggtacaaagatcaccaaatctagccaggaaggagcctcagagattgtatgacccagcttcctagcaactccctcaaagtcactgagaacagctgcattagggccaaaacccaggcttcctgccccaaatccactggtacttccattcaacagagtaatctgagacactgtgtcatcaaaggtcacagaatatactctatatacaaaatagagtatatctttcttttaaaaaataaaataagtaggccaggagtggtggctcacacctgtaatcccagcactttgggaggctgaggcaggtggatcacttgaaaccaggagtttgagaccagcctggtgaacatggcaaaaactgatttctactaaaaatacaaaaattagccgtgcatggtggtgcacacctgtaattccagctgcttggaaggctgaggcaggagaatagcttgaacccaggagatggaagttgcagtgagccaaaatcacgccactgcactccagtctgggtgacagagtgagactctgtctcaaaaataaaaataaaaataaaaaaatttaaaaaaaacaaacacacacacacacacacacacacacacacacacacacacacaacaaaaaaaaccacctctggaaattagtttcttccagaaggtccaaggggtaaccataaagtaaatgcaaggacccatgatctctgtgctctttgttgagcaataaaatcaaatatttgtttcctcctccataatataaccattaactttcactaaaaatacacttattcttctcatgtaagaggtcacatcaggggagtatttaaatgagcatgtgctaagctatcacagataacagttctgcctgtaccacccaccccagcagcccggagaggcgcaggctcacacacgatcccacatgtaggaccaggagtccaacctggaaccctgtgaccctcaaatttgtgtaatttcaaccaacctcaccactcactgcttccctaaagtgcaaagtgcccgacagatttccactatgcatatattaagctctaaatgacaactgctcaacatatttgaaagttcacaagaatacaggtcatcaagttctgatggtcaaagatcctggaactcactgattttagtgttgccctaagcatcctccctatctgcctaaaacttgctctcctgcagagcctgctgccaacagagtggcttgggcttcatgccccttacttttccctccaggccacataaaaggcccacatacaacagcactttaaacacacaagcatacactactcaacattagctacacagtgggaaaatttctgttttgaaaaatcaaccaatggggccaggcatggtggttcacgcctgtaatcccagcactaagggaggctgaagtggggcagatcacttgagctcagaagttcgagacaagcctgggcaacatggcaaaaccctatctctacaaaaaaatagaaaaagtagctgagaatggtgatgtgcacctgtagtcccagctacttggaaggctgaggtgggaagattgcttgagctccagaggtccaggctgcagtgggctgatactctgccactgcactccaatctaggtgccagaatgagaccctgtctcaaaaacaataaaaataaaaataaatcaaccaatgggggtgtccatgaaaaataccatggcaggccgggcgcggcagctcatacctgtaataccagcactttgggaggccaaggcgggtggatcacttgaggccaggagttcgagaccagcctggccaacatggtgaaaccccatctctactaaaaatacaaaaattagccatgcgtggtagggcgtgcttgtaatcccaggtactcgggagactgaggcatgacaactgcttgaacccaggaggtggagactgcagttagccaaggtcgcaccactgcattccagcctgggtgacagagtgagaatctgtctcaaaaataaaaaataaaatacaatataataaaaaataaaaataaataaataacatgcgacatatgacattttactactaaagataaataatggcaaaccagtcagttactatttttcatctacctcggccagccaaaactggacaccctagaagtccccaggttgggaataatgatgaacactcagatggtgtgagcaggggaacgacttcaatgagaccaggagaggtgcctctctgtgcctgcaatgccacctgtctgcctgacctccacgtccctaggctgccctagcagttctgccaccaggcccacccctctggtgtacaaggtgaaggggacacatgcaagtgctcaagactcaaactactatggggtgaggaggagggaaggcactgtaaggcagacacaagggatggcctagaaggttggttaaatggaagggagagaatatggaatgaaaataaatactggaacataggtgctgggcttaggacttgcagctaggagtgacgaagaaagggaaaaacaacttctacaagtcatttgggaagaagcggacccaagctgggacaggacaggatggaaacaggctctccaacacgatggtgccacacaggaggcagggactgtgcccgccatgccaacaacgtcccctgaaggagactggggccatagctccgaggcctgagcgccgacaagaggcttccaggcctgcacttgtgggaaggagccaaggaagggatggaagcagggagctggcccagcatcagtcacaagggcatgagacacaggatgaaagtggagtcagatttaggacctgggagccacccggcagggaaccaaagcaagtgcccttgtcaattggttgagggggttcgggcaggtcatggagaaagggagtgaaggatgtgccatggtggacacacctatggggctgtcatggaaaagctggtgatggctgcagcagtcacatctagaggcataggggcctcaacactgcacctttctaaggaatttactgtgcgtcaccaggcaacacttaaagcatgaacacagtatctgcagtttttatcattcaattaatgaatactcaccacagctattacaggaatgagtactcccaagttccctgcactgctagaagcctagaaaagaacagaattattgtcattaacgagtatgtgtttcttttattaaaaaaaaaaaacacaagatacaacatagtgttatgtaaacctggaatgtcttaatctaagagaaatgatgagagatatgcagagagaggcagagagatgctcatccagcataattttaatagcaaaaaatgaaaacaaatgtgaaaaataaaccatggttacataaatgattacataaatcatggtacttctgcataattagatatgacacagctatttaaaatacaactttctgaaaagcatttagtcaccatggaaagagcccacagcacatgtcaaatgaaaaaaaaatcaagatttaagactatgctatgattcaatcccaattatgtaataaatacatatgcataaaaaagctaggaagaaatctgtcaaagtgttagtaatgattatatatctgagtcaagggataagtgctttttactttactatttataggcttctgtatcttttctaaaataaacatatattcttcccaagttagggaaatttggggggttacttaataaaagatagactctctggctagacacacaaatgtagctaatcttcagtacacactgattagtaaaaattctggaagcactggcctaagccgacttgatttatgctcttaatctataataacagcagctgaagaccttgagcatacactgcggccaggcactgtgctcagtgcttcgcatgcactaacttctgggacgattcatgggaggtctcagtagcttgccaaggccacacagcacctcagtggtggggacagaatgccaagctgtaaacatatacacctactatgtactcacaaaaatttttttgaaaatttaaaaagaatgccaagctgttttccctgggctgggggccacaagggtggccctgcctggtcccctctgggaaaccgatagcctaagggatgcgtgatgatggagaacaacccacagaccttagtttaatttataattatagctccttgtcctccacaaggtggggcactgaggtccaatttccaggggagagcaggctcctgaaacgcccctcagacaggttacagcctctgctttctcaggtgctcagcaccaccttgtatcatcagtaccccactcttatcctgatgcctaaggtcccgctagacacgcgggacacacttctctcctgtgcactgaggtggtcccagctgtgtaccccactgggagacttgggaagttagtcagccacatgactgtcggagggcccggcatagcaaggctgaattagggacaagagtcttaggatccctgcttgcatcggccactctctcttggctgagactttcacagggggactccttcatgcagttgtcatctcaaatgccactcttcagagaagccttctcaaccagcccaatctaaagtgcccctcaccaccctgccctgtttcactctcccactcagcgccacaggcagagaggaccctgtctgtctcgttcacttctgtaacaccctcatctagagcaagggctggtaaactatggcccatgaaccaaatccaacccaacacctgttcttgcaaatacaattttataggagcacagtcacgcctgttcgttcatagacaggtgaccacagaagagttgagttgagcagttacaacagaagctgtatggcctgcaaagcgtaaaatatttacactctggccctttacagaaaaagtgggctgacccctgacctaggacagtagctggcacagagtaggtgaacaataactgtctgggggaaggggaaggaagaaatggaagagagaggaaatgacaaaacagggtggaagtagagatatggttgtgggatacattggggtttttctttaaataatctgatcaatcttttattttttaatttatagtacccccgactttttcttttttttcctttttgcctttattaaatgcctaaacacgcctcagtaccaagtgttatcaacaccaactcatattcctttccttatttaaaaaaaaaaactttctagctcattacaaacacccccttcccctttctctccactttcttttacatacccaccctatctaaaaaaatcaaatgtttagccaaccaaaattagtttaaattatatgacccaaccccagccaataaaaaaaatacaaaaacaaaacttgagtcaaaaataaaaattctcgtgccctttattcaaatatgctcttataacagctagcccaaaagacacccctctacgcaaaaataaaattgctttactaaaactcttctgttcaaatattcaatttccttaaaattttaagggttattcctaacatggtagagcgactagtgcccacgtgacatgctactggggagttacgaaggaagaggcctcacctgcctcggccccaccatgaatgtatttggggattcaagacatgacgtttatctcagtagacctgtcttccttgggaggcctgagattaggtgaaatctggcccttctcatgttgccactgtgttctgatgatgggcccttaaagtcctcctaggcccagctaccacccctgggcttcatgataaaggcaaggacagagagaggtgcccgtggggagctgaggctagactgttgtcatgtcaccaccctaggatgggtcgggcagcttttatgagctggatataacccagtgagaaaactgccctctcccctgatccccaccagcatccttgagaaagaaccccaccccttcttacttgcattccaggcacatttaaatcattcacaaagaaagtgccatattccaaccaagatggtgcctgaagactaagccttggccagcagggataggacactgatggggaaggcatagccatcctccttcctacctttagggcagggcccttctcgcttgccctctcgctggctcgcttcccctccagccccagctgcacaaacaactccaacaggttcatgagcagctcatccaccaggtgctcgtcttggatgttggccgcgatgttggccagggcattaatcactgccagggagcaatgcctgaagaagaaggagtgaaataacagccactgccaggccctcaaccgtccccaagggacggcactgcaggggtgaggcgagctgagcgggccaggcccagcctgccttaccacactcctcccagtgtctgtaaaccaaagaactctcaagtggagaagaacatgtcatcttcgtgaaaaacaacctgtagaataaagccaactgatgcagaaatgactgcaatcctctctcctgaaatgtagtaaggacctccaggagactaagttctaggcatctgcaacactgggtacctgtgagggtctcaggacacttccctcagggctgaaaatgaaagggcccatgcccaggcattccaggttggatcttgcttcccccctacaaatcacaaagagccttaaagcatcatttaccacccacagaactttcacctcatgaccagcttctccctaacgctgcctccaccttggagctgatgtcagtattttttcacatccaatgctcagcaagtgttccagggtcctgcctcaggatcttggctggcccaatgtaaaccccggatgtgaagctgacattgcccctttggccagaaacctgaaaccactgaggccaaccaggcttctgtggccctggagactgccagactctgtcatgtccaagcggcacgaccctgggtaagtctctttaagtctttgagcctcagtttcttcctaagtaaaacaaggatgataatttctcttcgtaggatcacgggaagagtgaaacaccacgtgaagcactaagcatgtcgtctgctccactaagaaatcccagagcaacggcagccacggcaaaaggcactgcagttaagtaatacctggtaggtcaagggcaaacaaagggcagtaaatgcttccactggtgaggaagacgacaaatcatttttggtgacaatatgagaaaaggctttatggaaggagaggcaagctgagccagaactgaagaactggaaggatgaagactggcaggtgctacagacacagggtaaggcatggcagaacacctaggaggggtggaagcaaaggaaaccggggaggcagctggcgaggcagctggggacactcctggagaaagggcccagcagtcacataggcgcaaggaagcaatgtgttggcctgtgtgcaggttccatggcagagaatgggacagaggaaggaaggaaaggagagcctgaccccatccccaatccagtcttcaggctgttctagtagcctgggctcatgacggtggcagcaagaaggcaatgaagtagtatcgatgcgagagacagctctattgattgggagctttcacatatgcaatctcattcccaactgcaggcaggttctcatttggcagatgaggaaactgaggcacagaggttcagcattttctgaggtcatgcagctacatggcatggctccacagctgcactcccacccactaaactgacatggagagaatccagaggaaggcctggacttcacagtcagaagggaggagcccggaggtcaagaagagtaacgcctgcaaaggggctctcttcttccctccccaccctcctgtcctcatctgacttcacctctccccttccctctcttccaaacacggatgaacatgtccctgtcctcaaggcattcctagaggagggtaaggaatagccaagaagcatctctcaatctgtcagggaaaactggtcagactttatacaagtatcaaatgttcaaggacgtttaacgcctacttccttggacccaaaatcctacttctctgaatctaacccacagaaagcatcaaagatgctcagagatatgtagctgttaggctgtcaatgctgcatttattagtgggaaaactggaaaacaccctaacatccaagctagagactggctggttaaatcttggttctactataggataggacgctccacaacctctaaaggcaacctgcgcaggatcattcatggtgtggctgatgtgctgccccataaaaaagcaggtcagctgcatgtgcagcatgggcccaatcagaaggagagaaaggagctgagacctcgtgcgctgagatgctcagtggtcacctccaggtgggggccacattgggttttcacttccccccttatgtgtgcactgatctgtagcatatagttttcttgcaagaagagtttatttaagagacaaattcacaaacctcacatttttaaagtaagttaaatactgtcatgataaaaaagtgacaatgaggtccagttacctatagccgtggtccttgtaatctttggtggctgagtatacaacggagctggccttcacactgatctgctggaagaggttccacacttcctgatagatgtattgctgggagagagcaagatgcactgtcaccatgcaggatgccctcatgaggcccctcctgtcatcacctagagagaaagctctggaatcctggggcacaacagcccaaagactatcagcccaaagatcatccatttctaaagctttaatcaaacctcaaattaaaagctaaaagggacatggcttagattcaaatcttctgttataatacactgacaagaaattaaacctctttttccccagcactcacagcatcttacactattcttactactccgcattaaaaccgttgtcagcatttagctcatctgcaaggtatatttaatctgtatttgtacatcccttatagtcaagagtttaacgtagcttgcacagggttagtggtgttctggctctggcctcccttacatttccggtgataaccaggcagcccagctggtcaataatcagcacatcgaggggggagggtggctggcagaatttctgctgtaggatctgcagaatgggctccatgaccttcggggtgtccctcaaggccaccgcaatgtgtcccaaggctcggattgtgtggtcgggaatcaagtgagcgtccctacagaaggaagaacagaagcgccctagcaacagtccctccagcatgcagtagtgaaacagtacccagagactacgatctagaccttaatttcataacagtcttgatgcagtgttcatctgaaactgacagcccaggattttaaccacgggcagaaacataagccccaggcactagtctggatgacaaagatctttctcgacttccacacagtggtccaggaagtacaatccaaggtgggcttcaccttaaatcttgtgacaaccctgatacatgcctatgctctgagacaaggagataaggacagaggcatgcatacgcacaatgccaggtgccccacacgagcctgctgagaacaatgggctgcctctgagagacaggaataggggcgtacttgtcgctctcctgagagatgtagagccggttggacaggctggccaagaacgcctccacaatcactgggtccaccgtcaatccagccttcaggcacctgaggagcaagaaaacccatgtggcactgaggcatcaaaccaagataggttttttgttttttaatttttccttccttaggcctacaaagtttaaagaactgctctgaattttcttccccccaaattggaggtcataacacagaatgaattcaaagaattactccagattttgcccacttgataaatgtctcagtcggaaacaataatttcattattttgcccagaacagtttcctttggaatatcatgctcaccctaattccaatttcaatcccttgtactgtttcttaaggtcacagtgactgattccaaagacaaacggtcccaagatagcatagtaaacatcacaattatataccaaggttttcatggtaaggagaaacatttacgttacagagaaaaggggaaaaatttaaagcccctaaaaacataaaatcttgtaagatgtcctagctctccacatctgtttggctcctgggccagagtttggaaaacagtttgagtctgacagacaagctgccatcttgatttagcttctaagggcaaggaaccagaatccagggaaagaagtatttgcatggaaatcagactgtatgtagctctcaagttggaagaacaagagtccacagtgcaggagtctgggcagcaaggggtacctaatcatattttaaaacctcacatttatattaaacattccacagaaaacaaggtaaagaaaatatgatgatacgttactctggatgttgagctaatggataatccttctctttttacttttctatacattacaatttttctctagtaagaatttcttagccaggcacggtggctcacacctgtaatcccagcactttgggaggcacaggtgggcggatcacaaggtcaggagatcaagatcatcctggctaacatggtgaaaccccatctctactaaaaaaaaaaaaaaaatacaaaaaaattagctgggcatggtggcgggcacctgtagtcccagctactccagaggctgaggcaggagaatggcgtgaacccaggaggcggagcttgcagtgagctgagatcgcgccactgcactccagcctgggcgacaaagcaagactctgtctcaaaaaaaaaaaaggaagaatttctttttttttttgagacggagttttgctcttgttgcccaggctggagtgcaatggtacaatctcggctcaccgcaacctccgcctcccgggttcaagtgattctcctgcctcagcctcccgagtagctgggattacaggcacgtgccaccacgcccggctaattttttgtatttgtagtagagacagggtttcaccatattggccaggctggtctcgaactcctgacctcatgatccacctgcctcggcctcccaagtagctgggattacaggcttgagccaccacaccaggcctcttattatgtttatgatcaggaaaagaaaagaagtaacaagaaataattcctctttatagatcaagtgtaggtttaaaataatcagaaacaagctttaaaaaagtataaatgcagccaggcacggtggctcacgcttgtaatcccagcactttgggaggctgaggcaggcggatcacgaggtcacaagtttgagaccagtctggccaacatagtgaaatcccatctctactaaaaatataaaaaattagccaagaatggtggtgtgtgcctgtaatcccagctacctgggaggctgaggcaggagaattgcatgaacccaggaggcagaggttgctgtgagctgagattgcgccattgcactcccgccccaggcaacagtgcaagactgtataaaaaaaaatgtataaatggggtgggtgcagtggctcacacctgtaatcccagcactttgggagaccaaggcaggtggatcacctgaggtcaggagttcgagaccagcctggccaacgtggtgcaaccccatctctactaaaaatacaaaaattagctgggcgtggtggtgggcgcctgtaatcccagctactcgggggaggctgaggcaggaaaatagcttgaacccaggaggcagaggtagcagtgagccgagattgtgccactgcattccagcctgggcaacagagcgagactcaatctcaaaaaagaagtataaatgtctcttattttgtaataacccgcttgtctggagcactgctgtctactcgccacttgcccagcttcccacctgcagatgttgtcaatagcgatgtctcggagctgctcgtacatggagggctggctcttcttacccgacatgacgttcagggttgactcggaatgctcattggtcacactgatttttatatcattgccagcaactgaaagtaaaaaattcaaatatatacctagttaggcctatcattttccatcaccttctttgtaattcaaaaaccaagataatatgctgatcatttataaaagcaaaatgatcactctaaaaacatctgaccaaatatttcagaaagagaagagtctaagagcaacaggaaataatatgtttaaatcaaaaggaagaatattcaagttagaaagtgataaatacagaaaactaccaatttctcaatcaactgttcaaaagtactgatgaccaaccaccaaaggcagctctgagggcgactgaggcatggccctgtgcttggagttacctcactaatatgtacaaagcctggtgagggttagggatgcttgcgggagcaggggccttagagcctgagagaaccctccccactacggggttcagggaagtcttgttttttgtttgtttttgagatagggtcttgctctgtcacccaggccggaatgcagtggcgctatcacagctcactgcatcctcaacctcctgggctcaagccatcctacaacttcagcctcctgagtagctaggactacaggtgagcgccatcacgcctggctaaatctttaaactgctctgactttaagtcttcatctgaaggggaagataaaaacagccaccttcatgagactgtgggtaagagggtgatactacatcagagacactagcacacagcaggtgtttaattaattaatgttaattattgtttcatcatatgtggaaacatcataatccattctcgcaggggtagcagggactgggcccctggctaagtgtttggggcacacaggatttgcatttcagacttccacagtgaaagatgtcaaaaagaaaacaggacttgaaggggcctttggtgtaacaggaatacaggatgagagaaggccggggaagaaaggcctggagcttggaggggacgcaaagggaaagacagaaggaaaggtgtggcgaaggaatgcacccaggtacagtcatgaaacctgtgtgaggctcacacacagtcacagagcccctttctcagggcctgaagggcacatagtctgttattacctgtgtggtactgactgtggtacttgtagagcttcaccagaactggggacgggatgaccaggaagtctcgcaaggacggtgtcacagagtgcaccaccaccgggaacctctcgcacaggcggcccaaaccctgcaacacaccatcaacctgtcacatggcctgtggtatgggaccatctgagtaggccctgagcagggaggtgctcaacccttcagtacccaagtctgacccaaaacttcgaaggtcaaagctcccacaggccacctgcccaggacataaaaagatggaagcgatggtgctgactctcctccacctataggggacatcaactactatttttttgttttgtttttgagacagggtctcgctgtcgcccaggctggagtgcagtggcacgatcatggcttactgcagccttgacttactgggcttaagcaatcctcccacctcagcctcctgagtagctgggactgtaggcacacaccatcatccctaactaattctaattttttaaattttttgtgcagacggagtctcactatgttgcccaggttgggctcaagcgatcctcccacctctgcctcccaaagtatcgggattacaggagtgagcaaccgtacctggccaggggatatagattgttaaagtgtgctcatctcttttggaagcatactaaagaagaaagggacaaaatataatttttaaacaatggcaggtgtggagtcagtgggattgtgacaaggttaagagtctcggcagagcagagctagcactgtgggtgtcaggagacatccccttgcgtggccccatggcacatgtccacagtccttcccccacaggccttgggaatggcccccagcctcacaacaacggagaactgaagccagctgcacccatatgccactgacagaaagccctggcatcctgcagggggcagcccacactcagtgatgaactgtgcacagcacgcactggttaaagctcctaaagacagaaccggcagggtctccgctgctggtgtgcccaccacagcctgaacagcaacagcgtgacaagagggaggccctacaggtgggatctgagcctctctgggttcagggagactgacctgcagacagcagatcagcaggggcaagtgagcaataatgactttgctggacgtcttggactgcagcttctcagatagcttgatgcaaaggttttctgcaccttaattcaaaaccagaagaggagatgagtgatcagcacaggccagtctttctaacacacttatccaccaagtaagcacagaatttaataaaaccccagagacatactttaggcagggcttattcatactgagaggtcacacagtgtgtgacactctctctctcttctccgctggccctaagcccccttgtccccgcagtgttcattccacagaaaacttcccattctactcctcccccagaaaaacacttcacctgaaggcactgagcttccatgtcaccacagaaaagcctaaagaaccagcaagatgcagcagagagcatacacaggccctgaggccacgggcatccccatcctcccaggtccagtgccctccatgcaggacaggacaccagacgtgcagagcacagcaggggctaatgctccactctgcacgtgcccaggaggcctactgcaactgcctgtgctggtaacagagccaagtgttctagaagtagtttggggaaacttgtggcaagaaagcctctgggtcatgcctggagctcacatgagaggcaaggcagtctgtctcaccctgctcgtccttcacagcccacaccatgaggtccacacaggcagcattcgcctgacagcgcagtttgagggggctcagctcattgtggatccggtctgcgtcatgtagaatcttctggagctccccctggctcgtgttgaactgctccagcacaaaatcatggatctccttcacaaaagaggtcgggaggtctgtaggaaagagtgtggcatcacagctgggaacaaaactacagtagaacacaggcagtgctagcagcggctacagtcttccccttttaacaaaaaccccagaaaagtagcatttgctactggccactgtgggtcctagaatgcccactggaaagaagttggataggaattgcacagctgtcctccacgtgcacacaacctggcaatcagaggaaatgatcatttcccagggatgttacagccatgctttgttttaagcagtcaacgtactaaaacctgaatacatgaaacatataaattgggaagtatcgttgctggaactacttccactgacaatatgagatacttctgtgatttttttttcttttaagaaagaggttgtcagggccaggcgcggtggctcacgcctgtaatctcagcaacttgggaggccgaggcgggcagatcatgaggtcaggagatcgagaccatcctggctaacacggtgaaaccccatctctaataaaaatacaaaaaattagccgggcgtggtggtgggcgcctgtagtcccagctactcgggaggctgaggcaggagaatggcgtcaacccgggaggcggagcttgcagtgagccaagatcgtgccactgcattccagcgtgggcgacagagcgagactcccatctcaaaaaaaaaaaaaaaaagaaagaaaaaggttgtcagataagggcaaaaactggttgcagccttgagaagagaattatctggatcttcagagcactcaccctgagtttgagagacttttcaaactctcatccccagggcctggaaaattcaggagaaccaccatgatgcacgcacaagtcagcccagccaaggcagccagcaacacacagcaggggtggtggggagggcaggggtaatccctgatgccccttcttagggagtttcaacccttgccgtggcccagatgactcagcttctgaggaatgttcagaatcagattaggaaagtggttactaaattttggtataccttcctgacaaaatattatgtgctcatcaaaacttaagcttacgaagaacactcaacagtgtgaggggagagcataggaaaaacattttgtaaaatgcataaaagattgtttcctcacttctgggaaaaacaaaattcatgaaagagggactagaagaaaatgctaaattgttgtgtgtgcatgttaactattaagctattgtctcaggttgggtgcagtggctaacacctgtaatcccagcactttgggaggccaaggtgggtggatcatttgaggccaggagttcaagaccagcctggccaacatggtaaaaccccatctctactaaaaatacaaaaattaggcagacgtggtggcacatgcctgtaatcccagctacttgggaggctgaggcacgagagaattgcttgagcctgggaggcagaagttgcagtgaccccagatcatgccaatgcactccagcctgggcgacagggaaagactctgtctgaaaaaaaaagctagtacctctacattaacagattacatgtattacaagtacttcattttcttttttttaatgtttttgagatggagtcttactctgtcacataggctggagtgcagtggcacgatctgggctcactgcaacctccgcctcccaagttcaagcgattctcctgcctcagcctcctgtgtagctgggattacaggtgcatgccactgcgcctggctaatttcttttgtatttttagtagagacagggtttcaccctgtttggcaaggctggtctcgaactcctgaccttaagtgatcagcccaccttgtcctcccaaagtgctgggattatacgcataagccactgtgcctggcctcttttttaattttttaaactatctaaatggatatgtaaaactgtatctgtccttaggacaatataacatgcacattttagataaacaccttaggaaataaactcagcaaaggagccatcatcgatggtaccggggttgcaggatcatggacagattttttaaatttgcttttttcccaaaatttcagtaacatgaccactttgctcatatgtgtttttcagtggccccagcagaaagtgagtaccagtctgcaaccactagcatgcgacagtggcctgggagccagtcttgctgtactcacaaacacatgggcaaactgtcctcacccttcatgtagtacagagtgtcacgcagcatcttgaacatggtcaggtagagagggtcactgaaggaagtgtagtagagatcagcactggggttggcctgcagggaaggcagacacacatgactatagaacagaaatgcccttctgcccaccctttgccttcacagcaaggcccagcggaatggtgattcgtgacttagcattctaaatgaagcaactgtttatcatgactcatcacttggacactctactgtcttcatcctcttaagcatcagaccaaggaaaacaggaggctcatgcagtccagagatgcctgcgggggagcagccatctgcaccctagtaggaagaacctccttgctgtggctgaagctcaccatctttggccatcattggcccagacagggacatgggaagtggtgaaggaggaagactgacaaaggccaccagagtaagggatccacactgtccatcatcccaaggatacaaattacagccaggacaccttcagatacaacttatgttttgtaattaaaactcattttaaattattctttaggaatctatttgaaatgtagcactattcttcttctgaaaaaaaaaaaaaaattcacacaaggtctaatgagttaagaaagataatagtccagcccgggtgtggtggctcacgcctgtaatcccagcatttggggaggccaaggagggtggatcacctgaggtcgggagtttgagaccagcctgaccaacatggagaaaccctgtctctactaaaaatacaaaattagctgggcgtggtggtacatgactgtaatcccagctacttgggaggctgaggcaggagaattgcttgaacctgaaaggcagaggttgtggtgagcagagatcgcgccattgcactccagcctgggcaacaagaacaaaactctgtctcaaaaaaaaaaaaaggctgggtgcagtggctctcgcctgtaatcccagcactttgggaggccaaggcgggtggatcacgagatcaggagttcaggagttcaagaccagcctgtccaacatggtgacaccctgtctcttctaaaaatacaaaaaattagccgggcgtggtggcgtgcacctgtaatcccagctactaaggaggctgaggcagaattgctttgacctgggaggcggagcttgcagtgagccaagatcacgccactgcactccagcctgggtgacagagtgagactccgtctcaaaaaaaaaaaaaaaaagataacagtccttaacttctatatactcctagttgagtaggatggaaaattatggtttatcataactcgtttttttcatttttttttttagagatagggtctcactctgtaccccaggctggaatgcagtggtatgatcacagctcactgcagccttgaactcctgggctcaagtgatcctcctgcctcagcctcctgagtagcagggactacaggcatgtaccaccatgcccagctaatattataattcttgacaagtataaaagtggtctgcaaatatagcaaatctttaaggcgccagaagttggccagagtgggatagggcatgcagtgtgaggttgacagagggtgagtgagcaggtggagaaaaaaagaatcatgtggagagtgtgagagtcatgccaattcccaggaggacactgacaggaagagctgtggttgacagcactgcaatgatggctttacagacaacgtctggtggtcctcacagggcagaaatggagaaatgagactgggagaggttaaagcagttcagggctttgactctgggagtccagacaacacgagtgttaaactttggagccttggagaccaaccatcttacaagcccacagcccagctccatcactcacgagctatgtaaataaagttcctgagctaagcctcagtttccccatatgtaaactggggattgttgtgagattcaaggagtgagtgagtaaagttctggcacataataagcatgtaataattggtagtggttattacactgattatggatactgagtaatatattgcagactctaggtcaagattacaagaaacttttttttttttagctatgaaactgtttcttcaaatggatgtttatgctaaagaacaaattacaaaacaaaaaataccagaaactgccctggttcaatgagaaggagggtcccagaggtggagtgcaggcccactaagtctccacttgtctaactgcccagcccagctctcgccctggtcctcctggtctgccctcagtcacaaatgatcaaacacttatgatggaaaaccaaaggtctctgagaccacaagctcagtctatagtgagtgagtgagagagttaaagctcaggccaatgggcagaacgacaacctgaaaaagggttggagacaaggtaggaactgcccagatgcaacttggggagttataagaactctgttacttaaccaagaaccaacccagaccaaaccacggccagcacatacatctcacatctgcaatagctcgttggcaggggtacgaagcaggaagagacatggtctacagcacatgaagggccctggtagttccttccctgcttcatacctgagccccaggtacagtggtatcaggcactgtgtgtcttaaaatcaggtgagagaaggaacaccaggcttcaataaggaatctgggtcagggacatacccatggtaataattagcctggcaaatgacaacctgtctgcatcctaaccctcaagaggggcctgacccaaatgttccccgagatttttgagacctcccagcaccaatgtaatgatttcataaataatgctgtaggccttggttccaaatacattaaagacaagagttccagccgggcatggtggctcacgcctgtaatcccagcactttgggaggcagaggcaggcagatcacgaggtcaggagattgagaccatcctggctaacacggtaaaacccagtctctactaaaaaatacaaaaaaagttagctgggtgtggtggagggtgcctgtagtcccagctacttaggaagcggaggtaggagaatggcgtgaacctgggaggcagagcttgcagtgagccgagattgcgccactgcactccagcctgggcgacagagcgagactccatctcaaaaaaaaaaaaaaagttccctagttacgcaccccttacacttaaaaaccaggacttgcatacgcctagaaaagtgtagctctgagcccagaggagcagctttggaagcaccaaaggagtgaggaagataaaagagtaggagagacccaggccagactcccagctcccacagtaactatgtgatgtgggcacgttagtgagttctcactaaaactctatcttctgtctgtaatgccaccagtcagaggcaccctgaggtgacgtatttaaaagagcatgcaacggtacctaccacagaccaagccctccgcggcaggtggattgttaccacatgaacaaggaaagtgaaaacactgcaaaaccccttccactccagcccccgctcaaactcttcctgctttctctacacacgtttaagtcaggctgatctcatggtaatgccctcagaagcgacatacctccatcacactggctacaatggcatccaaagatttgagaacagcctcctcaacgatcttcttcacctaccaaggaaacagaacctcatgaagcaactgacatacacagagacaggaatgctagctccttctaccgaaaacccatgacaaactcacatggtgaaaaatgtgatgcagataaaggccaataaatacaaattatggctatgtatcaaactatatgcacaaaatgcctttaattctgaagtcacttgggactgcttttctaccttagatagcaatgacataaaaacaaaggaaaaaggccaaactccctcagatttgttgacctgagatttctgtttccaggatgtgcagacctcaggccttgctgccatttcacccactcatggttaacaggcacagttgtgtgacatcctcttgcaatcccctcccagacatcaaggacaccctcacagccagtccttggagctcatggcacctccttcctctccgggccaggtgcactggctcttctacaactgcttaggtactcaaactagagctcatattttaaattttcaatagaagcaattattttcaccagttatctgtacagtatttagtgtaggaatgaattgttctgtcaactgcagaaccacaaaaaaaaaaaaaaaactgcccacatccacaattgtagtatttgatgaaagtcatttccaaaatgtatagataatgataaacatcctaggaaaagaaatgaaaaaccgcctaaaagaaaacctaggccagccgtggtggctcacgcctgtaatcccagcactttaggaggccgaggcaggcggataatgaggtcaggagatcgagaccatcctggctaacaaggtgaaaccctgtttctactaaaaatacaaaaacttagccgggcgtggtggtggtcacctggagtcccagctactcaggaggctgagggaggagaatggcgtgaacctgggaggcggagcttgcagtgagccgagatcgtgccactgcactccagcttgggcgacagggcgagactccatctcaaaaaaaaaaaaaaaaaaaagaaaacctaaacttgaagaaagttaaaagttaaaatatactgcaaaaaataataccccaagaaaggatgtgaaacagtcagtcttcagttagaatttctgacatggtactgggaacagccatctgtgaaggtcatggctctaccaggccaccattctatctggggcactgacactgagaagcagtttaggtagttttccttcttgacagcaacttcaaaaacatcctagcctatttagtaattcattatggttccatcctcattaattattacctatgttgtaatgtcttcttacatcttcagcctgaagccattctctgagggatttctattcacactccacacagcagggaggtggccactcctcagcacatgctccatgctatccaaattgttctcatttccaagacagcaagcccaatcttgagagtctggccttgatgacatcatcacccgtacctattcaaatctgtcttgaaccatcctagcttgattgtaacaacttcagggcccctggatctttattttgtaattttttttgagatggagtctcactctgttgcccaggctggagtgcagtgctgcgatgttgactactgcaacctccacctccaaggttcaagcgatcctcctaactctgcctcctgagtagctgggattacagggatccactaccatgtacagctaaagttttgtgttttttagtagagatgggatttcaccatgttggccaggctagtctcgaactcctgacctcaagtgatccgcccactttggcctcccaaagttgggattactggcatgagccacggcgtccaaccagggtccctgaatctgaccaaagctctggccatttaaggaatcgaacaatggccctggtgttttctctggtatcaccctcaatgtcatccaaaggtacccaaatatgaaaaagtcaggttttgttattaacccaaatagagccaccccttagaggaagtcaagcccaggaaaagcactggacttggagtcagaatccctggactggatgcagcccagctgctggcctacatatccatgacgtgtttgacaccgatttcctgacctccaaatggggatgcatgggtgcctccccaacatggttgctcaagaatgaaatgagaaaccagtatacaatgattccatgaatgttactctacttccttcattaatctgcaagtttatgactattaaattgtactttgaaatactggtactctgagtttttcttttaaaaatacaagtttcaccactagcaattttactgacatatccatggtctgttcatccatcagttctttgcttaccaggtttaagagttcccgaagcatttccaatggaatgttaaactccttatatgtgacaccgttgaaaaggggagagactgagaagctggagctgatggttgaaaagtagtactcaggctctagggcagtcccatcgggcaagcaggaggctggtgggagataaagctggaaactcagccgtggtgacaggcaactagggtacttcctcaagctgactcccccaataaccaacaaaggtgcagattttgcctttatttatatcccaattctctgcatgtttttaaattaacaactacagggtagattgcaaatccttggggactgatgcccctcacctgtgtctttcaggtcaaagactcagatatgatggtcctaatatttccatcttagacaatataacttagtatgtgggaagtgaaaaaagaattgtatcttttttatttttatttttatttttttgagacagagtctcgctctgttgcccaggctggagtgcagcagtgtgatctcagctcactgcaacctctgcctcccaggttcaagcaattctcctgcctcagccttccgagtagctggaataacagatgcccgtcgccacacctaggtaattttcgtatttttagtagagatggcgtttcgccatgttggccaggctagtctcgaactcctgacctcaagtgatccacctgtctcggcctcccaaagtgctgggattacaggcgtgagccaccatgcccagcagaaatacacctttttaaaggtgaagagatatgaaagcttggggtccacagggcctcagagatattttctcaccaaaattagaaaaaaaaatgcacactactagaagtttcaaagtcagagcaactaagtgaaatacacctgtcactaaaagacaaatactgtacgatcccacttattagaggaacttaaatcatacatagaggtagaatggtagctatcagtgactgggggaaggggaaatggggaataattgatgtatagtttcagtttcacgagatgaaaagagtttttgagatgaattgtagtgatagttgcacaatattataaatgtattcaatactactaaactatacactttaaaataattaaggccaagcatggtggctcatgcctataaacccagagttttcgaaggctgaggtgggaggattgcttgagtccaggaattcaagaccagcctgggcaatatagggagatcctgtctctacaaaaaataaaaattagccggatacagcaccatgggcctatagtcccagctactcaggaagctggagcaggagggttgcttgagcctgggaggtcgaggctacagtggagctatgaatttgtcactgcactccagtctgggtaacagagtaaaatcctgtattaaaaaaaaaaaatgacatagcaaattttatgttatgtgtattttaccacaataaaaaaaaaagaaggaaaaaaatcaacaaaaataaagtcattcagtcatttgacatttaataaatataaacccagacccaatgcagtggctcacacatgtaatcccagcactttgggaggctgaggtgggaagatcgcctcatcccaggagtttgagaccagcctgggcaacacgacgagaccctgtctctacataaataaaattattttaaattaaaatagaaatatagtaaataggaacccaaaagcatataattgtttgaaaatccattatttagaaactataatagaaaactatgaggccaggtgtggtggctcacgcctgtaatcccagtactttgggaggccgaggcgggtggatcacaaggtcaagagattgagaccatcctggcaaacatggtgaaacgctgtccctactaaaaatacaaaaattagctgggcgtggtggcacgtgcctgtaatcccagctacttgggaggctgaggcaggaaaactgcttaagcccgggaggctgaggttgcagtgagccaagattgcaccactgcactccattctggtgacagtaggagactgcgtctcaaaaaaaaaaaaaaaaaaaaacaaatcaaaacaaacaaacaaaaaactatgattgaaaaacagatgaatttgtaatattttcataagacagtatcaattcataaagaagtgaatactaaattttatgactttttcaagcactagagaacagactcaaagagtttagtttagctccagttgtgtcaaagctggtatctcacagctggcagcacactgccaatctgtctaaagaggacgcaaaccagcaacttacagcagaaaggatgggcaacaataccactgggagctgagacgccaagaggccaacataagaaatggccactgaaagagggaacaagtaaggaaagaagggagggagaaacagccggattaaaaagggtagatgagggagaagggaaggttgtgattatcgggcacttctcagaaagacaccatgaaatatgggctaagtcctgtgtggctgaaccccacagaggacacagatgatggcaaacgacaggggctgcaggaactagggacctaacatttgggatttacgcagggggtgtcattgaaacttcttttttttttttcctgtgagacaagagtctcactctgttgcccaggctgcagtgcagtgtcacgatgtctgctcaccgcaacctgcgtctcccaggttcaagtgattctcatgtctcagtctcctgagtagctgggattataggtgtgagccactgcacccggctaatttttgtatttttagtagagatcgggttttgccatgttggccaggctggtctcgaactcctagtctcaagtgatccacctgtcccaaagtgctgggattacaggtgtcagccactgtgcccaacctgaaagtttttaagcaggaaaagaagtgatcaaatttgcgctattaaaaataattcttatttattttttattttatttagtttttaagggtctcactatgttgcccaggctagtctcaaactcctaggctcaagcaatcctcctacatgggcctcccaaggtgctgtgattacaggcgtgagccacatctcctggcctaaaaacaattcttaaaaactaaattcttacagcagtttggaagagggcctgggaagggagatagaaggaccggctgtaagaaaagtcttagtatgtggtgttgtatacctgaagtcccagctacttgaaagggcaaggccagaggatcattatgactgcacccctgcactccagcctgggtgacagagcaggaccccaactcaaaaaaaagaaaaagtccaagtaaaacaggtagtttgagaggaaactcagaaggcacagggtctgctgctgtctgtcctacagtgaggcatttcagagagcagggctcgcttgtctcgtcaccactacaggcaaagtgggcggcagccaagtctgatggagtgatacgtggggatctcgcagtcagccacattagtgtgctcccatctgccacttactggatgtgctcaaagtggggcagcggtcatggagaggagccctcaccacagagggtggacaatgagctgtttaccaggaaaagggaagcctccaagggcacatcatggccatcctaaaatgccccaaaggcaggcaggtggcagtgagattttcagagcctggaggaatacattctatacttaaacaaggagttgtctctaagaggtgcgattctgagtggctgaaattagctcttatattctaacacatatatagaatgtaacctgttacattctcacagatctaagagatggaaagcttcctacatttatgtaagcccagatattccctttttccttcaaaattcccctcacatctctcgaaactgtcttgagacatgctcttttaacaaatagcattattcaaaaaaggagagactatactgaagcatggaattctgccttccccatttgctgtcccttaatctgggtcttacttccatcaagtaaggtagaaataattttaacatgtgtctgacatggcacagggtagtcacatgaatccaattcagtaaattatgtaaaagtactttgtgaacagcagagctctataaaaagtagtaatgggctgggtatggtggttcacggctgtaatcctagcactttgagagaccaaggcaggcgttcccttgagcctaggagttccggaccagcctgggcaacatggcaaaaccccatctctacaaaaaatacacaagttagtgggcgttgtggagggtgcctatagtcctagctacttgggaggctgaggtgggaggatcacttgagcccagaaggttgaagctgcggtgagccatgatcatgccgctgcactccagcctgggtggcagagtgagactctctctccaaaaaaaaaaaaaaaaaaaaaaaaaaaaaaaaaaaaaagtagtaacagtagtattactacattctttaatattatctacatacttaatgtcattaaaaaaaaatgtccagccaggtgtggtggctcatgcatgtaatcctagcactctggaaggaagaaatgggtggatcacttgaggtcaggagttcaagacaagcctggccaccatggtgaaaccctgtctctactaaaaatacaaaaattagctgagcatgctggtgtgtgcctgtaatcccagctacttgggaggctgaggcaagagaattgcttgaacccaggaggcagggcctgcagtgagccgagactacaccactgcgctccaacctgggcaacagagccagactctatctcagaaaaagaaaagaaatatccaccattagtacttccacctgaaaagaacttttacaagttaaagtgcaaaaattctgatggcaggtatataggggtctgtaagttattttctgtacttttctctctaaataaaatatttgaaaattaaatgtacttttctctatatataaaatatttgaaaattaaattttaagaaacttaaatgaaaacagaaaataaatgcttcctaaaagcttggcactctaggtccatccatgacaacagagttagtatcagcatccttaatatcacgagaagtcactgtgagcctgttctccaagtattacgtcaaaatattcttcggaaaggtgaagcccaccttcaaagtagtgaaaggcagatcctccaggggaactgggagggggcatgccgcgttcagggctgacctgaaacacacaaccacagttacatatcagaaaagaccagtgagacctccatcagatttgtcttagacaaggtcctctctgccagcccaatgtttgtacttcaagttctggttgaagcctcatttccttcctaaagcccatcacagctacagcattctctactacatgctatatcactaaattctttgtgtttagccgtatatttgacacttgattactgagctgaattgtcctcagtgttttgtgtttttgtcttttctccatgagtcaattatatacttcttaagggcaccaactgtcttccaggcaaaatagcatttggcacccaactgctatgaaacatatactttatgactatgaaatcacttataaatcttatgttggggactagcctcaacaccacctgtagggtatttgatgtttggtggcgacaaaggaatgagaagaaacaggttaagagtttataaaggcgggagccaggggaccagagcaaatcagaggccgcaaaggcctagagttttggtttttacactatttattgagtataatcacttagatttaagaagcagatgtttagggcgaaacggtgaaagggaggcagtgtgtcatatgtgtaatctatagtagcggcagtttaaatgaattttttttgtgtttaaacagtatattttcaacttattggacagcagttagtgggagcaggcttaactaggagtctgtatgtttggccatattttcatgttttaaaggagtggtttttttttttttaacacagtgtttatggataagagagtaagtcttgctcagagtatgggaacataatggcgataaggctttttttttagaggccttttgtggctttttacacctcattgttttatatttttatggccagtttatatgtgcactctataagcccttccccccaacatcttaagagggacaagacaagtctttgtattaaagagaattctagtgaaacatttcacgttacttaagtttactccaactacaaagaagagggattttcttcgcaggggagcttaacagggtctttctcctctgctctttccccagtagcccaggcccacctgagagatgctggacacactgctggttttcctcttcagggtaccctcctgacagacagtcagcagattgctggggaggatggagcggaagtcattaaaggaacgccttcgaacaccttcaagctcttccaggacacggagggaatgaggagggattttgggaaagagctttgagaggagagactcttccatgttgctgtaacgcccaaatgctcgcgagattcctatcaggcatgggatagcatacttgcaaaggtattctagaagatcaagtgaaaacgttacaatataagaaagtatcctgatagagtcatatagtaagtactaacttgtaacattgactaagatttcacaacccacccactaataactgtgaaggttcacaataagccacaataatggggtccaccccaagggctgacaagtgatatcttcaacctgtcattaacaacttcagactatgacttcaatacacccagctgccctgcttggaaggtcttcatctattcatggcacacccaaatcaataaaatagctaggccatattatcaagtaccttatacatttattcctcttaggagcatattggtagcctcacaacacagaaaaaatgacctttggaagtcaactaatctacccacagatgttacaggtgaagaaactggggcccagaagggtgaagttacttgtccaaggtgacccagcgtctatgtagcagagcaatgcacatgaccccatgtggcctctgaggatactaacacacaacaaatcaaactaaaataggaaggttttctcccatcatatatattaggtacccaacaacagaaaagactggagaaaagcaagggaaagagtaaccacaaaaccattttaagaaaaaccttaaggatactcgtacctttgtcttgaatctccaaggcctggcacatccccaagaggacatgcaaaacctgcaaaagcacctctaaaatctgtaacagtcaaggaaacaagaaaaaaaaaacataaacaaaattaggtaaatatcacgaaactaagtcagaattagaaggcacttcagacattatcttaaccaaccccatatatgatacatccctccacaacgactgtgccaagtggccaaccagctgactttccagggacaaaaccctcactctctgggctggttccgagttcctcccaatactgggccaatgttgtcctcctggggcttgtacctaccagcccttggggctgctttttcctctattaacatattctgtaaacaggtgatgggtccccaaatcttctcttttcatgggtaaacgccctagcgcttttcaaccgtattcttcatgatcataaatcctttgtaatgctaattgccagcttctgattttacggtagtccagttttctgtctggaagtgtagtgctcagaataaaatacattaacatctgggatgctggaactcacccagcatactcaccaaactcatcacagattctacacttctatgtatgtgacattagcttttctgcagccacttcacactgcttatgtgaagctcatctcaatgagcttatacataatttttaaattttttttatttgtttgagacgaagtttcgctcttgttgcccaggctggagtgcagtggcatgatcttggcttactgcaacctccacctcccaggttcaagcgattctcctgactcagtctcctgagtagctaagattacaggtgcatgccaccatgcctggctaattttttgtatttttagtacagacagggtttcaccatgttagccgggctggtctcgaactcctgacctcaggtgatccacctgccttggcctcgcaaagtgctgagattataggcgtgagccactgcgcccagtccataattatttaagttaagaaatttttttttgttcctggaagggtggcttatgcctataatcccagcacttttgtttgtttgtttgttttgaggcgcggtttcactcttgttgcccaggctgcagtgcaatggcatgtctcggctcaccacaacctccgcctcctgggttcaagcgattctcctgcctcagcctccttagcagctgggattgcaggcatgcaccaccacgcctggctaattttttatttttagtagagacggggtttctccatgttggttagtctggtctcaaactcccaacctcaggtgatcgatccacccacctcggcctcccaaggtactgggattataggcatgagccactgtgcccagccaatcccagcactttgggaggctgaagcgggtggatcagttgagctcaggagttcagacctgcctgggcaaagtagcaaaaccctgtctctacaaaacatacaaaaattagccaggtgtggtggtgcgtgcctgtggtcaggaggctgacgtgtgagggtcacttgagcccaggaggccgaggatatagtgagccaagaacagtgcaggggttcaatgatagctcactgtagcctcaaactcctggactcaagcaatcctcctgcctcagcctcctaagtagctgggattacaggcatgtgtcactatgcccagctaatttttatttttatttttgtagggataggttttgctatgctgcccaagctagtctcaaattcccgggctcaagtgatcctcctgcctcagcctcccagaatgttgggattacaggcgtgagccaccatccatgacaataagcttatagatgaggaagatacctaagtcttctttcgcacctgcttctcctgaactatgtaatctctactaacgtagttggtattttttatctttcatctacccctacaaaaactcatggtattagctttagctcactgtacaaatctgtgattcccagctttgtgccttctccaaatgaaatcaacttgctttccagatcttcattcacagcactagcttgttttgctccaatgacaggagggtcctgctaggccgatacctcactgatcaccctttgggacagtccttcaggcagttctgcaaaccctccaaaccatttggccctcagcccatataactggtccaggatgtcaggaaaggtgcttgtccaaagcatttatgaagatccactagaatgcagcaacttcatttctctcaaccattcttcttagaaaacccaggcaaagaaaaaatgaagttggtgtgacatgacttgttcataaccaagtcaaatctcttacattttcctaatattaagtaatgctgaataatctacaaaagcttgaaaagcaatagtttttccattttatttatttattttgagaccgagtctcactctgttatccaggctggagtgcaatggcatgatctcagctcactgcaacctctgcctcccaggttcaagtgattctcatgcctcagcctcccgagtagctaggattacaggctcctgccaccacgcccggctaatttttatatttttagtagagatggggtttcttcatgttggccaggctggtctcaaactcctgacctcaggtgatccacccgcctcagcatcccaaagtgctaggattacaagcctgagccaccgcacccagccactttttccattttatatgttaaagtcatgttatcacctttggtgttgacctctttattctgataaattttattcatagaaaaaagcccttaatgtccaactttttaataaaaacacattattctaacatatttaagtatttctttagccaacctacaaataaatgaagaatctaaattagtcaaaatacatcactaactgggaacatttagaatgcagacaagcaactaggcactgtttggaagaacctaggaacagcagcatacaaaaactaactttctaagcgataaatttaagaaaaagttgtatgattacattctttgtttaaagaacaggaaagtatgaaatacatgtttgtaacatttctatcaaaattaacaaaatctaaagaaagtctgtgcccttaaagataaaagcttcagctacctagaagattctcttctagctgggcacagtggctcacacctataatcccagcactctgggaggtcgaggcagaaggatcacttgaggcccggagttcaagaccagcctgggcaacatggcgaaaccttgtctctacaaaaaatacaaaacaaattagctggcatgatggtgcacgcctatagtctcagctacttgggagtcttaggagggaggctggcttgaggtggacggcagaggttgcagtgagccaagattgcaccactgcactccagcctggatgacagagcaagactgcctcaaaaaaagaaaagaaaatgatcttctatgaatgacttcaatccccaacaaagagcaagaaaaatgagctgcctctgcctttttctgccgcctaccttaaaggactttctgaaaagctgaaagggatagtgctgctcatgtctctgcagcccctgcccttcattagaaaaaagaaaaaaaaaaaaagaaaagtttaataagataagactcgagatcctaaagagtagtgaaagacctaagcatgtcttaggtctgctgtcaacaggatgaaatagataaatatcaacaaacaattcaatcacatttcacgtttttaaaatcttttcatcactttgggactctattcaatctaatagaaatgcataccaaatcaaccaacacatgcttacctcatccctaagtgaaggatccctataggccacatcagacagcagagttaccaagcagaagctgaagctctctgcaaccgggagggcacctggaagatgtaaaaacataaatcagataaccaggaaccagatactgggtcacacctctggccatccaattcaatatgttccctctcaccatgacctgccaagggaccagtttacagcagctgccctccttgagacgagtctcaaaagaacagctatgggcccaatgagtttgctgagaaacacccttacctttcctttaagtaaatgttttggttcaataaacttaaatgtttcctgagccaatagctagtgtgagataacaaagcctctcaacatgacagattcaattttttattccctaagtaaatgtgataaatcacacacacacacacacacacacacacacacacacacacacacacacaaaacactcggctgggcgaagtggctcaagtctgtaatcccagcacttttggggggccaaggcagacggatcacctgaggtcgagttcaagaccagcctggccaacatggtgaaaccccgtctctactaaaaatacaaaaattagctgggtgtggtggcgcacacctgtaatcccagccacttgggaggctgagacaggagaatagctcgaagccaggaagtggaggttccagtgagccgagatcgcaccactgtactccagcctgggtgacagaatgagacgccatctcaaaaaaaaaaaaaaaaatcaattttgaatattgaatgttgaatcaaggaaaaaagagtatccactatttaatagctatattcatagtacatgacagaagacttacatttctactccagcacttaaaattttaaagtgcagctctaggctgttctcaaacttgaatgtgcccatgcccggcctaaaatttgaccttttagtaatgatgctctatttaatttgtagtccatcaaattgcaggacagactgggtgcagtggctcatgcctatagtcctagcactttaggaggccaaagcaggcagatcacttgaggccaggagttcaagaccagcccagccaacatggcaaaatactatctctaccgaaaatacaaaaattagccaggcatggtgatgcatgcctgtaatcccaggtacttgggaggctgaggcacgagaattgcttgaacccaggaggtggaggttgcagtgaaccgaggtcaggccactgcactacagcttggagtgcagacagagtgagactgtctcaaaaaaacaaaaaacaaacaaaatcctaacaaattgcaggtacatgcataatttgggatctgtcagttttaggcatgttaccagaaatgatgaaaacccaaaggttaagaggaatactggcacaaacagaatgttttttaatttttatttcaggttcaggggtacatacgcagttttgttatacaggtaaactgcatgttacgggggtttggtgtacagattatttcatcatccccgtaataagcatagtacccagaaagtagttttcccatcctcaccttcctcctattctccactcttaagtaggccccagtgtctgctgttcccttctgtgttcatatgtactcgaagtttagctcccacttacaagtgagaacatgcagcgtttggtttcctgttgctgtgctaattctcccataacggtctccagctccatccatgttgctacaaaagacgtgatcttggccaggtatggtggcctcacacttgtaatcccagcactttgggaggctgaggcaggcaaataacttgaggccaggagttcgagaccagcctagccaacacggcaaaactccatctccactataaatataaaaattagccgggtgtagtggcacatgcctataatcccagctacttgggaggctgagacaggagaatcgctcgaacctgggaggcgagggttgcagtgagcagagatcgcaccactgcactccaagctgggtgacagagcgagatcgtctcaaaaaaagataaaataaaataaaaaataaaaggacataatctttttctttttttatggctacacagtactccacggtacacatacgacattttctttatccagtcttccactgatgggcatttaggttgattccttatctttgttattgtgaatactgctgtaataaacatacttacgcatgcatctttacagtagaatgatttacattcctttgagtatatacccaataatgggattgctgggtcaaatggtaatcctgttttaaattctttcagaaattgccaaactgcattccacaatggctgaactaatttacattcacaccagcagtgtgtaagtgttcccttttctctacaacctcaccagcatctgttatttcttgactttttaataatagccattctgactggtgtgagatggtatctcattgcaattttgatttgcatttctctgattattagcatcagatgatgagcatatttttcatatatttttggccacttgtatgtcttcttttgagaagtatctattcgtccttggctcaccttttaacggggttttttttttgtttgtaaatttaagttcctcatagattctggactttagacctttgcatagtttgcaaatattttctttcattcagtagggtggctgtttactctcttgacagtttattttactgtgcagaagctctttagtttaattaggtcccatttgtcaatttttgtttttgctgcaattgcttttggcatctttgtcattaaatttttgccattaaatctttgccagggtctatgtccagagtggtatttcctagtatcttccagggtgtttatagtttaaggttttacatctagatctttaatccatcttcagttgatttttgtataaggtgtaagtaaggggtctagttccaatcttccgaatatagctagccagttatcctagcgccatttattgagcagggagtcctttccccattacttgttttgttgactctgttgaagatcagatggttccaggtgtgcagcattatttctgggctctctattctatttgtctatgtgctattttttttaccagtaccatgctgttttggttactgtagccctgtagtagaggtgaagtttgaagttgggtaatgtgatgtctccagctttactctttttcagactaccttagttattcaggctcttttttggttccataaaaattttaaaatagtttttttctaattctgtgaagaatgtcattggtagtttgataggaatagcactgaatccataaattgctctgggtagtatggccatgttaacaatattgattcttcctatctatgagcatgggatgtttttccatttgtttgtgtaagctctgatttctttcagcagtattttgtaattcttgctatagagatttttcacctccctggttagctgtattccaaggtattttatcttttcttttttttgagatggagtctcactctgtcgcccaggctggagggcagtggcacaatcgcggctcactgcaacctccgcctcccaggttcaagcgattctcctgcctcagcctcccaagtagctgggattacaggcgtgcactaccatgcccagctaatttttgtgtttttagcagagatgggtttcaccatgttggccaggctggtgtcgaactcctgacctcaagtgatccacctgcctcggcctcccaaagtgctgggattacagtcgtgagccactatgcccgactggtattttattatttttgtgaatattgtgaatgggactgtgttcttgatttggctctcagcttggatgttgttggtgtataggaatgcttctgatttttgtacattgattttgtatcctgaaactttgctgaagttgtttatcagatcaaggggctttgggcagagactatagggttttctaggtataaaatcatataatctatgaaaagagatcgtttgacttcctctcttcctatctggatgccttttatttctttctcttgcctgattgctctggccaggacttccagaactatgctggataggagaggtgagagagggcatctttgtcttgttctggttttcaaggggaatgcttcgagcttttgaccatacagtataatgatggctatgggtttgtcatagatggctattattactttgaagtatgttccttcaatgcctagagtttgttgtggatttttttggggtttttttttgagacagagtcttgctctgttgccagattggagtgcggtggcgtgatctcggctcactgcaacctctgcctcccgggttcaagcgattctcctgcctcagcctcccgagtagctgggactacagatgcctgccaccatgcctggctaattttttgtatttcaggagagacaggatttcaccatgttggccaggatggtctcaatctcctgacctcgtaatccgcccacctcggcctcccaaagtgctgggattacaggcgtgagccaccacgcctggcctgttgaggatttttaacatgaagggatattgaattttatgaaaagcctcttctgtatctattaagataatcacatggtttttgtttttagttctgtttctgccatgaatcacattaattgatttgcatacattgtatcgatcctgtatcccagggataaagcctacttgacctggtggattagcattttgatgtgctgctagattcagttacctagtattttgttgaggatgtttgcatctatgttcatctattggcctgaagttttctttttttgttgtgtctctgccaggttttggtatcagcatgatgctaccctcatagaattagggaggagtccctcctccttaattttttgtaatagtttcagtaggagtggtaccagctcttctttatgcatctggtagaattcagctgtgaatccatctggtcctaggctttcttcagctggcagactttttactactgactcaatttcggaacttgttatttgtctgttcagggattcaatttcttctgggtttagtcttggtaggttgtatatgtccaggaatttatccatttcttctaggttttctggcttgtaggcatagaggtgtttgtctctctgggttgggtttttttattattattatttctgtggagtcactggtaatgtcccctttatcaatttctggttgtgtctatttggaccttttctctttttttctttgtaagtctagctagtgatctttttttttttattcaaaaaaccaactcctggatttgttgatcttctgtatggttttcatatctcatttccttcagctcagctttggttttagttatttcttatcttctgctagctttggggttagtttgttcttatttctttagttcctctagttgtgatgttaggttgttaatttgagatctaacttttcaacgtcagcattcatgctataaacttccctcttaattctgccttagctgtgtcccagagattctggtatgttgtatcttcattctcattaatttcaaataatttcttgatttctgccttaatttcatcatttacccgaaggtcattcaggagcaggttatttaattttcatgtaattatatgctttcagtgattttcttagtatttaattctatttttattgtgctgtggccctatgagttcagtttttctgaatttgctgaggcttgttttatgtcttatagtgtggttgattttagagtatgttgcatgtgcagatgagaagaatgtatattctgctgctttcgagtggagtgttctgtagatatctattaggtccatttggtcaagtgtcgagtttaaatcctgaatatctttaacagttttctgccctgatgatctgtctaacactgtcagtggggtgttgaagtgtcccagttattatgtggttacctaagcctcttcataggtctctaagaacttgctttatgaatgtggttgcttccgtgttcgatatgtataaatttgctcccgtgttggatatagtcaaatcttgctgaatcaagccttttaccattatgtaatgcctttctttgtcttttgtgatcttcgttggttggaagtctattttgtctgaaatcagaatagcaatccctgctcttttttccattttccatttgcttggcagatttttttcatccttttactttgaatgtatgggtgtcactgtatgtgggattggtctcttaaagacagcataccattgggtcttgcttctttatccaatttgccacaatgtgtcttttaaagggatatttagtccatttacattcataatattgatatgtgtggctctgttcctgtcaccatattgttagctggttattatgtaggcttgtttgtgtggttgctttatagtgtcactagtctaggtacttaggtgtgttttgttattgttgttgtttgttctttttttgagacagagtttcattcctgttgcccaggctggagtgcagtgatgcgactgtggctcactgtaacctccacctcctgggttcaagtgattctcctgcctcagcctcctgagtagctgggactacaggcatctgccaccatgctcagctaattttttgtctttttagtggaaacggggtttcaccatgttggccagcctggtctcaaactcctgacctcaggtgttccatccgccttagactcccaaagtgctgggattacaggtgtgagctactgtgcccagcccttaggtgtgtttctgtagtggttggtaataatctttcccttccatgtttagcattcccttcaagaccctgtaaggcaggtggtggtaaagaaatcccttagcatgtgcttgtctcaaaaagatcttatttctccttcactcataaagcttagtttgaccggatatgaaattcttcgttgcaaattcttttctttaacaatgctgaatatgagccaggcccagaggctcatgcctgcaatcccagcacctttgtgaggctgaggagtgggggtcacttgaggccaggagttcaagaccagcctagtcaacatggcaaaaccctgtctctactaaaaatacaaaaattagctgggcatggtggtgtgtgcctgtagtccccagttactcaggaggctgaggcatgagaattgcttgaacctgggaggcggaggttgtagtgacccaagatcgcaccactgcactccagcctgagtgatggagtgagactctttctcaaaacacaaacaaaaacaaaaacaaaaacaaaaacaaaaacaaaaacaaaacaaaacaaaaaggctgaatgtaggcctccattctcttctggcttgtagagtttctgctaaaaggtctgctgttagcctggtgggactccctttgaaggtgacctgtcccttctctctagctgcctttaacattttttttctttcatttagaccttggagaatctgatgactatgtgccttggggatggtcttcttgtgtagtatttcataggggttctctgcatttcctgaatttgaattttggcctctctagtgagattgggaaaatactcatggataatatcctgaaatacgttttccaagttgcttattttctctctccctatctttcagggacaccaatgagttgtatatttggtctctacataatcccatatttctcagaggtgttcattctttattttctttatttttgtctgagttattttggagagctggtctttgagctctgggattctttcctcagtttggtcaattctgttgtttattttgaaattctttttttttttttttttgagatggagtcttgctctgttgcccaggctggagtgcagtggcgcgatctcggctcactgttgcctctgcctcccgggttcaagcgattctcctgtctcagcctcccaagtagctgggatttacaggcgtgcgccaccacacccagccgatttttgtatttttggtaaagatggggtttcatcaccttggcaaggctggtcttgaactcctgaccttgtgatccacctgccttggcctcccaaagtgttgggattacaggtatgagccactgcgcccagccgaaattcttgaagtgagtttttcagctccatcagctcagtttggttgttttctttttgagacggagtctcactctgttacccaggctgaagtgcagtggcatgatctcagctcactgcaacctctacctcccaggttcaagcgattctcctgcctcagccacgcaagtagctgggattataggaacctgccaccacacctggctaattttttgtatttttagtagagatggggtttcaccatgttggccaagctggtctcgaactcctgacctcaagtgatctacccaccttggcctcccaaagtgcagagattacaggtgtgagccactgtgcccggccggttttttcttaaaatggccatttcatcttacatctcctatatcgttttattgtatcctttacagtctttggattgggtttcaactttctcctgaatgttgatgatcttcgttcctatccatattctgaattctatttctgtcattttggcttggttaagaaccactgctggggaactagtgcagtcaacttagcagcaagaagacactggcttttggagatgccagagttcctgtgctggctctttcttatcttcattggctaatgttctttcaatctttgaagctgctgtcctttggatggatttttttgggggtggtgcttttatcttctttgatgtctttgggggtttgattgggttcagtcaactggcttcatttctgacagatttttgggggactaaggctcagctcagcactcctgggctatgtcctccaacactggggggctggtattgggcactcagctttgttctctggctctctgaggttgagaacatgcagcactggaggggttgaggtgttcttgggccacagccacaacactctgaagggtagtgccagccaaagcactctgtcggatagtggcagcctatttgcttgtgacagcagcaccagcagtgcaatggggtgcatgctcattggctgaggcagggtgctaggaggcctggggctgcctgcctctatgtgggcattggcagtagcagtggtgcacggccgctggggtctgtgtgcacatttgcaccaatggcagtggtagcacagagttagagctggtgacctctgtgcatgcgttcatgcctgtggcggtggtgttgcggggcccagaatgttaatgagaacagcaaaacccatctttagcagactgggacatgttgcccagactagttttggtttgtttttgtttttttttttttttttttttgagacggagtctcgtgctgtcgcccaggctggagtgcagtagcatatctcggctcactgcaacctctgcctcctgggttcaagcaattcttctgcctcagcctcccgagtagctgggactacaggcacacaccaccatgcccggctaatttttgtacttttagtagagatagagtttcaccatattggccaggctggtcttgaactcctgacctcgtgatacacccgcctcggcctcccaaagtgctgggattacaggtatgagccaccacgcccggccgacccagactagtcttaaactcctgagttcaaacaatctgcccacctcggcctcccagagtgctagaattacaggagtgagccaccataccagccaatttattccgtttctaaaggtgcaaagtttaactggaacttagaaacaaagtgatgaaactatttacagtgaacattgctgttgggtctccaacctccatctcaccctttttgagcagcagcaatataatctggaaaactgacctcactccaggagtgagcctataaattctaagggtaacagtgactgatttggggacgggcagatgacccaattctggccaatgagacatgagaaaaggttcttgaaggtctcaacgttcttgctcactctcagaagaatgcaatggaaagctggcctacccaggcctaccttctccccaactcatccatgggctgtggccaacacatggatgtaagctcagcccacaatgctgcaggcagttgtttcccagccaggagggagacaagatgcatctgatgtgtcagtatgaataaacacttgatcctacagacactgaacatgtgtattttctcttatattcagggaaaacattatatacaattacctctgcctttccgagctgtgctttcttctacccaatacacttttggaagacctttgagaagtcgaagaaggtaaggaaccacacaatctttgtgctaaaaaataataagaagaataataaattagatttaataaaataagtgattggcagctttttagcccagattaagcccaaagcaaagcatatccacatcctaatcatctcagagattctccagggataatgtaaagtgcatgtaaattcacatggcatcactccattcctgttttcacactgcagagtccagaggctgtcctatcaacctgtaccacaggagcctaaggaagggttcgcacctgccttctggagctgagggtccagcctgctcaggcctcttctgggggctgggcctctccaggaggtacacgtgtgtacacactcaaagctgtcttcagtgagaatggtttagagccccaaaacccatccatgagccccagaataagatcctggggatggagagaagctcacaatgcgggcatctcaactgggtgatgcttttttctgttcatgtcccttgtccattttccttgtgttttttttttttaattttctacttcatgtttcctcttgttcttctcaagttgagcatcagactttatagccaactttagcccagtgaaaaattttactttcctctaatttctgaactagccaatcaacaccaatatatagcttcgtaatcttccatcattggcttttggagctatttccctatttacagatgttccagttaaggattagatgtgctccagagaagaagtgtgctctagagaagaggagtactatttgatgttttgaaatgctgacaaaccacatggtagttttaaaaacatggctgcagccaggcatagtggctcatagtggctcacacccgtaatcccagcactttgggagacccaggcaggtgaatcacttgagctcaggaatttgagacccagctggccaacatggcaaaaccctgtctctactaaaaatacaagtattagctgggtgcagtgggacgtgcctgtagtcccagctacttgggaggctggggtgggaggatcgcttgagcatgggaggtgaagactgcagtaagtcaagattgtgccactgcactccagcctgcgcaagagagtgaaatcctgtctcgaaaaaaattaaaacataaaagcatggcagaaggtggccgggtgcggtggctcacacctgtaatcccagcactttgggaggctgaggcaggcggatcacgaggtcaggagatcgagaccatcctggccaatatggtgaaaccccttctctactaaaaatacaaaaaattagccaggcatggtggtgggcacctgtagtctcagctacttgggaggctgaggcatgataatggcataagtaaacccaggaggcggagcttgcagtgagcctagatggcaccactgcactccagcctgggcgacagagagagactccatttcaaaaaaacaaaacaaaacaaaacaaaacaaaacaaaaaacaacaaaaaaacatggcagaaggcatgcagcttccacctggctctttttcaggacatttgccctggaacctagacactatgctgtgataagacccatgaatgagacttcaggtgattcctgcccccagcttttgagccaccccaaccgatgctaaatggagtcagttgagccctgtctaaattgcagattcacgaatcaaacaaaatgatgtattaagcactaagtctggggggactttgttataccataatagataactaaaaacaaagaactttatcaaaaacaaaagttttttctctaaaccataaaaaggaactggctaagacatctgtcgaggatcctagtgtacagacaggaacaaaactccataaggcctgaaccacatggcctcctgcagaggaagtggctccaggtggctctttcctatataaactgtgatgacattagcagcacagggtgagtaaaaccacctcagctcctctggccacagctgctaccatggcagcccactgctgggacctgaaggaggtcaatgcacagcccatcctggagggaagcaaggaatataagcaccaggtaaaaaccaaggtggtccctagggctttctcagggggctggcaaagcatgctaggcttctctcctagtatatgcaaggccggtgggctgccctggacatacaggcaaactctatggtccaagggacaacatcacatgccacctgggaccctgctagtccttacccagaacctgaatgacacttgtgctcatctatttgttgtcatcttaagaagtctaatacaagtacaacactttcaggacttacaggtaaatctatcaagaaacgtgtttgccaaagatattatcaagtaatccacatttgaacaacaatagtttcttataaatttttttaaaattattttttgccctttataattcattttatatttatgtaggatatggtaaacagaaaaaaaaaatggttttctttcttttcacatttataaataaacaggcaagctgggtatggtggcacatgcctgtaatcccagcactttgggaggcctaggcacgaggatcacttgagaccagggttggagatcaacctgggcaacctagcaagaccctcatttctacagaaaattaaaaaatcatgccaatgcctataatcccagctgctcaggaggctgagatgggagaatcccttgagcccaggagttcaaggctgcattaaataatgactgtgccactgcactccagcctaggcgatagagtgacactctaagaataaataaataaatagcagaagaaaggccaaaatgtagcttatgtatctaattttggttttttatgtaaccttgatcaggtaacctatttaattattaaaatactgctctataattaaaattcttatttgtttccaatgtacaaatactgttaaaatattaatgcttattagagcaaaatttccaggagatggaagcaacctgttctagataaatattcaaatatctaacatctttatttacctaacacagcataattaacttggaatttagaaatagtatctagtaatgataaaaataaataaataaataaaagattcaatatccaatgatcaatcatttgtttcaaatagctttggtaaatataaaaatacacatacacaacagtcacactatttttttgttggagctacagggctagattttaagtccctattaaaaggtacactgaggccaggcatgatggctcacacgtggttcacgcctgtaatcctaacactttgggaggcagaggcaggcggattacctgaggtcaggagtttgagaccagcctgcccaacatggagaaaccccgtctctactaaaaatacaaaaaaattagccaggagtggtggctggtgcctgtaatcccagctactcaggaggctgaggcaggagaatcacttgaaccctggaggcagaggttgcagtgagccgagattgcaccactgcactccagcctgggtgacaaagcaagactccatctcaaaaaaaaaaaaaacaagatacactgatacatactctaaaagtttatatacataatcgcaattttgaaaaagatgatattatatcaaaattacctaaaatgattttgtccttttggaaggagaaatacaatacccctgagtctgactgataagcattttacctgagcttgaaaaccaaacctaccctggaaggcacacaattacttctcaaagcattttaacttactctgtggcacataataacaaacaaacaaaaatacactttttttacaacataatatatgcacacaattctaaaaaactcaaattttctaagaaggtttacattaggaagtttcattcccaccttgtcctaccctctccactaaccactttgattaggttcaaatgtattcttctactattgctttaggtaaatataagcagatacaaacttaaacgctcactacacccccttttacaatgaagaaacttttaatttcatgaagacttacctgaagatcagattcaatcagaaaaatgcccaatgcaatcactgcatctctccgtctttcatctaactggaagatcccatggaaatccactggacacatgcaaagaagcttttggacctagaaaatgagacccccccaaaaacagctctacaaaatagaaaaccacattcaaaataaagcaagctgagtgcagtgtcatatgcctgcagtaccagctattcaggaggctgaggtgggaggataacttgagttgggagtttgagactagcctggccaacatagtgagaccctatctcttaaataaataaaaataaaaaataggccaggtgcagtggctcacacctgtaatcccaaccctttgggaggccaatacaggtggatcacctgaggtcaggagttcaagaccagcctggccaacatggtgaaaccccatctctactaaaaatacaaaaattagccaggcgtggtggcgcacacctatcgtcccagctacttgggaggctgaggcagaagtatcacttgaacccaggagacagaggttgtagtgagccaagatcgtgccactgcactccagcctgggtgacacaacaagactctgtctcaaaaacaaacaaacaaacaaaaccactaccataaaccccaaagagtccatgtaaccaataagtcatagttttttttcagttaaaagatcacaggacatctccagctgctgaaacaattgtacacgtgcccctcaaaacacataaactctgagtaatatgagctgaaggttaaaactgtgtatactcagagggggtaagacacaatggctaaagtttgcattttggtgttaggacagtctaagtgggtgtccccaccccttgaccacgaacaggttacccaaaccaacctgcattaacaatgcctcactgactcttttaaaaaatcaaatgcatggccaggagcggtggctcacgcctgtaatcccagcactttggtaggccgaggcaggcggatcacgaggtcagaagtttgagaccagcttggccaatacggtgaaaccccgtctctactagaaatacaaaatgtagccaggcatggtggcgagcggctgtaatcccagctactcaggaggctgaggcaggagaattgcttgaacccggaaggcggaggttgcagagagccgagatggcaccactgcactctccagcctgggcgacagagcaagactccgtctcaaaaaaaaaaatcaaatgtgtgaagcagttgggactgagcacagcatatagtaaatgctcaataaacattatctattgttattggatatactataatagtggctagtggaaggcaaaagcagacaatgagattcaaagaatgctgattaatgagtcaatcactgaagcacagggaagaactggccctatcaaagcctatgtactttgctctgtcctatgcaatactttatcaataccctgcactaaaacacagaagatacattccactacaaacctggcagatgaaactaatgtgctagaagacagcacgaagacttgaaaactcatcaaaattggcataacatcattatttctccaacaatagtgcctgaaagacaacttttgataatgtgatcagggagggcctctctaagatggttccttaaattgggatctgatcaagaaggaagccaggacaaatcaggaaaggctgctgctgcagcagcacagtggaaaagaagaagcaaggaggcccaggagttcaggtccagacagagaaggtccccagagggccccacaggccaggtcagaagcctgaattgtatcctaataacaaacacatagaggccttagggcatcaagtttagaactgaagtctagaagaatccctctggctgatacacagaaaatggattttggaggacaagagtgaaaacagagacaggtgaggagactcctgcagcagctgaggagactcctgcagcagctgaggcgaagatgttagcatggtagcaatcaacgagtagagacagaaacagaccagttcaggatgtgttttgaaggaagagttaagaggacttgatgatggacaggatatgggagagattactttagttgcctctttaccacactagaaagtatccaggccaggtgcaaggctcatgcctgtaatcccagcactttggaaggccgaggcaggaggatcacttgagcccaggagtttgagaccagcctgggcaacacagtaagaccctgtccctacaaaaaaataacaaaattaatcagctattgtcagaggcgtgtgaaccagagcaactccatcctgaataggggctgggtaaaatgaggctgagacctactgggctacattcccaggcagttcaggcattctaagtcacagggtgagacaggaagtcaacacaagatacaagtcataaagaccttgctgataaaacaggctgcagtaaagaagccagctaaaacccaccaaaaccaagatgtctggtctcgaactccttatctcaggtgatacgcccacctcggcctcccagagcgctgagattacaggcatgagccatcgcaccctgccaccaaggctttcttttttacataaagcataagaatggatttcctctctcaggccaggtgctctgggttgggctctaacaatatcccaggatcagaattcagcatcatcaacacagtttagccatactgccagtgcagcggtcaccccacccagtagaaagaactgaaggcagcattttttaccatcctcaattcctctggactgccagggcctcctctctttcaaatgcccagaggggctctggggtactctgacttcagaccttcctcccctatccccactcaactaaaaacatttaaatagaaataatctgtgaccattcagaaattactttaaaagccaggcatagctttaaatgtgaagtgaagataccaaaaagaacaactcagagatccatgtaatgattccatgatttatgcactacactggcatgtcaggcagaataatggcacctcaaagatgtccacaccctcaatcccctggaagctgtgaatatgttactttacatggcaaaagagaccttccagatctaattaaattaagaaccttgaaatggagggatatcctggattatttagataggcccagggcaatcacaaaggtcattaaaaggagaagagagaggcagaagagggagtcagagtgatgtgagatgggggcttggccaaccattgctccctttgaaaatgaaggaaggggccagaaatcaaggaatgtgggcagctctaggagctgtaaaaggcttggaaatgatggctgggtgcggtggctcatacctgtaattccagcactttgggaggctgaagtgggtggatcacctgaggttaggagttcaagactagcctagccaacattgtgaaaccccatctctactaaaaatacaaaaattagccgggcatggtggcaggccccgtggcaggtgcctgtagtcccagctactcgggatgctgaggcaggagaattgcttgaacccgggaggcagaggttgcagtgagctgagattgcgccactgcactccagcctgggcaacagagcaagactccatctcaatatatacatattaaaaaaaaatgaaaaaggcttggaaatgagttctcccctagagtctctaaaaagatacacagccctgccatcaccttgatttcagtccagtgaaacacaggttgtgtttctaatctacagaactgtaaaattataaacgtgttattctaacaacaagtctgtggcaatttatttacagtagtaataggaaactaatgtaattggtcactggtaattaaacaaaactcaaagcctactggactgcctatcaagaaaagtatcaaactgagtaatcagattacaggcaataggccgggcaccgtggctcacacctgtaatcccagcactttgggaggttgaggtgggcggatcacatgaggccaggagttcgagactatcctggccaacatggcaaaactccatctctactaaaaatacaaaaatcagccaggtgtggtggcctgggcctataatcccagctactcgggaggctgaggcacaagaattgcttgaacccaggagccggagatagcagtgagccgagattgtgccactgcactctccagcctgggccacagagcaagactctgtctcaaaaaaaaaaaaaaggccgggcgcagtggctcacgcctgtaatcccagcactttgggaggccgaggtgggcggatcacgagatcaggagatcgagaccacagtgaaaccccgtctctactaaaaatacaaaaaattagccaggcgtggcggcatgcgtctatagtcccagctacttgggaggctgaggcaggagaatggcgtgaacccgggaggcagagcttgtagtgagccgagactgcgccactgcactccagcctgggcgacagagcgagactccgtctcaaaaaaaaaaaaaaaaaattacagacaatatttagttccttctttattattttctgtatttcccatattttctataaaaaatattgataactttagaatcagaaaaaaatacggccaggcatgggcttacgcttgtaatcccagcaatttggaaggctgaggcaggagggctgcttgagcccaggagttcaagaccaggctgggcaacatggcaagaccctgtctctacaaaaaatttaataattagccaggcacggtggcatgcccctgtagtcctagatgctcggggatccgaggagggaagattgctagaggatcgcttgagcctagcaggttaaggctgcagtgagctgtgatcacactactacactccagcttgggtggcaaagcaagaccctatctccaaacaaaaaaagaaaaagaaaagaaatacagaatataccgaagttcatgtgctgcactgatatgcttacctgaactgcaggcctaaggatcactgacaactcccaaacatatgaagaagtgtaggtctaaggtcaggagaggttgcacagatgcaaccagcaaacgttcactttcaggcaggccatgtgttatcctattcctgttttacaggttaggcaactaggtccagataagttaagtgcacctgaggcaacaggttcctaactacatcttccttctcattttgtctcttcctactccaatatttccacttctggttcatataccttcaatggttccccattgcccaatgaacactcagtgcacactcccagccccaaaacttctctcataaacccaggccgctatgtatcaattctcatttctccctgcctggcctcttccatggttttgacccatctgaaacattttgtccaacctgccctatctcccctataaaaattcaacccatccttccaagatccatctcaactgtctcaaaactctcaaacattttccagaccccagcaacttgatgtaatatctcccatcatatctctcaatagctcacatagaactctgtatttctcaagataattaccttcctgatgtcttacagttacttgtatacttatcctctcactgcagagaggcctgtgacctcctcatcactccactgcaccctacacatttcagaactttaacaactacttaatgggactaaagcggccaaggtcacagacatttgataaggtgaggaggaaagaaaagaggtacagggctactagaaagcagggtttaactacactgtgataattgtcatatagtcagtaccaggcacagtgctggcatgcagttgacactgaacaagtatctgctgccttactgaatgaatggagggacggatggaagaactctcaaatgaagtaatatataatgtacagtcactccctcatgagcgttacaatccagcaggagttacaaaactaataaaaataatacaactagcaaataacacaagtcagaaactaaacgacagagggccctgaaagcctggagcaaaatgctcttggaaactgggactcttattagaaagacatctgaaaacttgaacctgggtcctacagaaaccatcacacccagttctggtgggtgccattctccaaataatgacagctaacacatattgaacatttatcatgtgttcatctatattatcttatttaatcctcacaacagctcattaggtagctattattaatcatcccccttttacatatgatgaaacagacacagagaggtcaaagtcctaatgcaggataaagcattaaccctctagtctttgaaaaaatgaaaagaaaaataacatcaaatggcttttcagaatcagaattttacaataaactagcaagttgtttgtttttaggggtcttagggggagtgggtcattataaaaagtcattaagcccaaaatctgaccacgatggccagggttattcccatttacaaaaaggatccagagggcttctacccaccactttcaaaaggttgttaagtcaatggaccacagggaggcaacaaatatgactgacttagactttgataagaactcttggcaatactttaacccaaggatattaaaagacaggtatctcaaagatgtgaattttgactgccaaggtaaggaaatgctaaaccaaggagaaaataagattcaaggagaaagtaagtctggatgactgggcagaaaattgcagatgagaatcaaccataacagagggtatttgtaaggtatttaggtcaaaataaagctacaataatagcattataaaagttggataattaaatgatttttttaaaagagtactacttgttatttaaaacctctgggaattgtcttcctggagaaacaaaattctctgagaacaaaagactaagatttaagtattaatggtatatttttctgttaaaaccatttgtaattgtctttctcaaatgtaccatcccctcagacaaaaaatattgaatataagctgatattttcgaagtgactcagagctatcatgataaacaaaggtgactgtgacatgatacacatggacctacaaatgtaaatggaacagcacctgatcctacaagcaccctggatcagagtttcattagagatgcgcttttgagctgagcgcggtgggaagtgcctgtaatcccagctgcttgggaagctgaggtgggagtactgcttgagcctaggagttagaggctgcagtaagctatgatcgtgccactgcactccagcctgggcaacagagcagaatcctgtctccaaaaatacaaaataaaaaagatgctctttggtcatctgtagacagattcatgaccttctaacaaacaaattcagcaaggttacaggacacaagattaagatacgaaaatcagccgggcgctgtggctcacgcctgtaatcccaacactttgggaggccgaggcgggcggatcaggaggtcaggagattgagacaccatcctggccaacacagtgaaaccctgcctctactaaaaaaaaatacaaaaaaattaggcaggcttggtggcgggtgcctgtagtcccagctacttgggaggctgaggcaggagaatggcatgaacccgggaggcagagcttgcagtgagccaagatcgcgccactgcactccagcctgggcaacagaacaagactctatctcaaaaaaaaaaaaaaaaaaaagaaaagaagaaaagaaaataaattgtatttctacaacgcagcaatgagcaaattaagaaaactattccatggttaattttatgttatatgaactttatctcaattattaaaaaaaaataataaagaaaaacactaacgcaggaacagaaaaccaaatactgcacgttctcaattataagtgggagctgaatgatgagaacacaggaacacacagtggggggaacaacgcacgctggggcctgtgaggtgggggagggagaatatcaggaaaaatagctgtcaggcacagtggcccatgcctgtaatcccagcactttgggaggccaaggcgggtggatcactttaggtcaggagttcaagatcagcctggtcaatatggtgaaaccccatctctactaaaaatacaaaaattagccaggcgtgggggcaagcgtctgtagtcccagctaatcaggaggctgaggcaagagaatcactagaacctgggaagcagagattgcagtgaactgagatcaccacagtgcattccagcatgggcaatagtgcaggctcaaaaaaaaaaaaaaaaaaaaaagggtggggggccaggtgcggtggctcatgcctgtaatcccagcactttgggaagccgaagtgggtggatcatgagatcaggagttcgagaccagcctgaccaacatgatgaaaccccgtctctactaaaaatacaaaaaaattagctgggtgtggtgcaacgcgcctgtaatcccagccactcagaaggctgaggcaggagaatcacttgaaccgaggaggtggaggttgcagtgagccgagatcacgccactgcactccagactgggcaacagagcaagactccatctcaaaaaaaaaaaaaaaaagtaatagctaatggatgctgggcttaatacacaggtgatgagaagatctgtgcagcaaaccaccatggcacacatttaacaaacctgcacatcctgcacatgaacctaaaataaaagttgaagaaaaatgaataaataaaaatgtaaaaagaaaaacaactgtaataatcccagcactttgggaggccaaggcaggaggattgcttgaacccaggagtttgagaccagtctgggcaacatagtgagtctctaaaaaaaattttagaaattaaccaggaggctgggtgcagtggctcacgcctgtaatctcaacactttgggaggctgaggcgggtggatctcttgagcccaggaattcaagaccagcctggggtacatggtgaaacccaagaccaacctggagtacatggtgaaacccagtttctacaaaaactagccaggccatggtggcttgtgcctgtagtcccagctacttcagagactgaggtgggaggactgcttaagcctgggaggtccaggctatagtaagctgtgataataccactgcataccactgctctccagcctgagtgatagtgagaccctgtttcaaaaaaaaaaacaaaaaaaaccagtagaacaatttcatttaaaatagcatcaaaaagaaaaagtacttatgaataaaaacaaaagaagtgcaaaactaagaaacattacaacattgctaaaagtaaagaaaacctaaataaatggaaagacatcccatgttcatagatcaaaacagttactattgtttagatggcaatacaggccgagcacagtggctcacgcctataatcccagaactttgaggggccagggtgggtggatcacctgaggtcaagagttcgagaccagcctggccaacatggcaaaaccctgtctctgctaaaaatacaaaaattagccgggcatggttgtgcacacctgtagtcccagctacctgggaggcagaggcaggagaattgcttgaacccaggaggcggaggttgcagtgagctgagattgtgccactgcactccagcctgggtgacagagcgagactccatctcaaaaaaaaaaaaaaaaaaaaaaagggacaatatagcaatacagtccaaactaacctacaaattcaacaccatccctgtcaaaaccctaggtgagttctttgcagaaactaacatgctaaccctaaaatttccatggtaattcaagggacccagaataacaaaaacaatcttgaaaaggaaggacaaaattggaggactcattcttcccaatttcaaaacttactacaaagctaaagtaatcaagacagtatactagccaacatcaggaaagacatacagaccaaataaaccctcacacttacagtcaactgatttttgacaagggttccaggacccctcaatggaaaaaagaatagtctttccaagaaatcgtgctgagacaactggatattcacatgcaaaagaatgaaactggacccccatctcatatcacataaaatcttaactcaaaatggatcaaaaactcaaatgtaagagctaaactataaaactgctaacaaaaaacacaggtgtaagtctttgtgaccttgaaattagacagtggtttcttagatacaacacaaaaagcacaagggacaaaagaaaaaaaaaatgacaaaatggacatcatcaaaatttaaaacttttgtacttcaaagaacaccatgaagaaagtgaaaaagcccacagaatgggagaaaatatttgcaaatcatatatcttattaagaaacttttatctaaaataaagaactattacaacttaattaaaaaaatactacaatttaaaattgggcaaagaatctgaatagatatatctccaaagaagatctacaaataccccaaaagagtggctgttctaggatagaataggctggctcaacatcattaaccatcaggcaaatgcatatcaacaacagaataataagatcccacttcacatccactaggatggctataactggaaagacagacaatacagagtgttggtgacaatgtaaagaaaacaagccctctgtacaccgttggtgggaatgtaaatggtgtagtaactttggaaaacagtctggagttcctctaaaggttaaacctagagttattgtatggcccagcaattccacatctagttaaagacccaagagaaatgaaaatatgtctacagaaacacttgtacgtgaatttccatagcagcgttatttataatagtcaaaatgtagaaacaatccaaacatccacctactaatgaatggataaaatatggtatatgcatacaaatattatttagtaataaaaatgaagtaatgagatgctacaacatggatgaaccttgaaaatacgccaagtaaaaaccatcatggcaggtgcagtggctcacacctgtaatcccagcactttgggaggccgaggcaggtggatcacaacaaggtcaggagatcaagaccatccggctaacacgatgaaaccctgcctctactaaaaatacaaaaaattagccgggcgcagtggcgggcgcctgtagtcccagctactcgggagtctgaggcagaagaatggtgtgaacctgggaggcagagcttgcagtgagccgagatcgcgccactgcactctagcctgggctccagagcgaaactctgtctcaaaaaaaaataaaaataaaaataagccaccacaaaaaaccacatcttatagaattctatttctacaaaatgttcagaataaatctacagagacagaaagtaaactagtggttgtctagggatggggctggtagggctgcagggtaacagcaaggtttcttttgagggcaatgaaaatgacctaaaattgatcatggtgatggatggacaactctgtgaatacactaaatatgatgaactgtacattttaaatgggtaaattttgtggtatgtgaattatatctcaagaaagcactattgaaaaacctagcctatgaaggatcaaatcaaaccacaagcaactgccgaccagaacaaagcccaacattccctaaagtaacacaacaaaaatctaaacactcaagccaggcacggtggctcgcctgttaacaccagcactttgggaggccaaggcaggtggatcacttgaggccaggagttcaagactagcctggaaccccgtctctactaaaatacaaaaaattagctgactgtggtggcgcatgctaaaggagtccccataggtctctgggactataaatactcatttaaaaaaaaatttttttttttgagacggtgtcttgctctgtcacccaggctggagtgcagtggcgtgatctcagctcactgcaagctccgcctcccaggttcatgccattctcctgcctcagcctccccagtagctgggactacaggccaccacgcccagctaattttttgtatttttagtagagacggggtttcaccgtgttagccaggatggtctggatttcctgacctcgtgatccgcccgcctcggcctcccaaagtgctgggattacaggtgtgagccaccgcgcccggcctactaaaattttttaaaattttcgctgggtacagtgactcaagcctataatctcagcactttgagaggctgaggtgagtggatcacttgagcccacggtttgagctaagcctgggcaagatagtaagaccccatctctaaaaaaatttttctttttttacttagccaggtacaatgtgcgtgcctgtagtcccaactacttgggaggctgaggcaggaggatccctcaaaccaaggaattcaaggtggtagtaagttatgatcatgccactgcactccagcctgagtgaaaaagcaaaactgtctccaaaaaaatgtaatttctatttttaaaaatgtctaggccaggcacagtggctcatgcctataatcccagcactttgcgaggccgaagtgggcagacggcttgagccctggaatttgagaccagcttgggcaacacagtgagaccctatctattttttttttaatgtctatttatccacccctctaataccagggcctagcacagtgcctgcaacacagcaaacccccaaagatttatcatatgaacggatggtgccatcttttgctttcataatagtatagccttgggttttttttgttgttgttgttgttttttgtgtgacggagtcttgctctgtcgcccaggctggagtgccgtggtgcaatctcagctcaccacaccacctcccgggttcaagcaattctcctgtcttagcctcccaagtagctgggcttacaggcgcacaccaccacgccctgctaatttttgtatttttagtagagacagggttgcaccatgttggccaggctggtctcgaactcctgacctcaggtgatgtgcctgcctcagcctcccaaagtgctgggattacaggcgtgagccactgtgcccggctgcgttggttatcctgaatccaggcttccagataagctttaaacacagaaaaacattcaggaaaagagaatggcttctgcagcagagacagagcctctcaggactcaataaacaaatgcaagtgagacctgaggatttctgcctcaactctgtatttatttgtcagtttaccacacaaatgaaagtagcgttctggccaacttggcaatgttcatgaaaggccaagcttttctccagcatgccaacatatacaacaaaagcaaatacaaaaataaaaatataaataagccatcctggctaacacagtgaaaccctgtctctactaaaaatacaaaaaattagccgggcgtggtggcgggcgcctgtagtcccagctactcgggaggctgaagcaggagaatggcatgaacccaggaggcagagcttgcagtgagcagagatcacgccactgcactccagcctgggtgacagagcaagactccatctcaaaaagtaaataaataaataaacaaataagcaatcaggaagataaaatgcataaatttcagcaactgacgtcaatgatggaaatagctgctggtgggaaagattagaggcaaccacacctccaatgagtgcaaactgcaaacacagacagcagaaaagagaatctgcagtaaggagtgagaaatagaacatttctgccccctggggagacaaacagctggtgacacaggagggcactgagggaaggctacgtgaaggcagagggagaaagtggcctcggaagaaatcaacattgctgacaccttcatcttgaacttctaacttccagaatgaggaggaaatatatctgtgttgtttaagccagtctgtggtactttgttatggcagcctagcaaactaatagttaatatggcatggttacaggtaaagattttttcttcttccaatttcttcttaaaatattttctagttgatttaataacaatgattctggcaccgcgtataccctccgctgaccctcattatctctctcctctcgctctacggatggctcttcttaacatagcctcacaaagcaaagggaaagaggataggaaattcttggcttcatgatactggaaaaacgccaacactatgatttttactccatggcagaccactctaaagtacagactgaataaccatgaactccagaaagcccactaccctaagcaccaagccacatattctcccaactacagattagaattaactcatcttatggagcacatatgtccaccaaggagggttcagcctgtccctaatgccgcagtgccatttaaacatcagatcgggctgggtgcagcagctcacacctgtaatcccagcactttgggcggccaagaaaagagaatcacttgagcccagaaatctgagaccagcctgggcaaaatggtgagactccgtctctattttctttcaaaaaccagatcaatagttagctacgacacctcaggattctggcattctaactgaagaaaacaaagagaacattttaggacatggaaaaagggctctgatcaaagcctcctgagggtggggagaggaatagaaggacaaggaatgctatctactttgcagctctgcccatgactctcggtatcccaggatcgagggcccactggtttaatacaggcctatagaggagagacacaaacaggccactgaacttccctgacaaaggaagattaaccaggcagggccaggaggaagcttagtaggggtggctcagcaacattctgaagacaggtgagaaccaggaaagcagaacaagactagcgggcagatagaaatcaggaaggaggagtctggaagccaactgtatatggagatcccaatgttgaaaagcctcactttctttcttgcctatttttttcttcttatctttctcccagagggagagggctgaggactgggtaggatttggttcaaagggcttcacagacagagtgtcctctgaggtgggttccaatcctgggggtgggaccccagtctaaagcacagcctagcaggaaaagctcaaagctcagccatggatcagaacagatgctcaagggtcttggctttggctatgggaacatggcaggagtctagtcaccagacctgaaatatgagagtagaatgggatcttggtcaggttggggtagctcacacctgtaatcccagcactttgggaggcgaaggcaggaggatcccttaagccctggaatttgagaccagcttgggcaagatggtgagacccccatctctaattaaataaaaaaaaaaaagtagatgggatttatggtatttcattggttcattaaaggaaagagaaaaaaaaaaaagagtagacgggaaacttgtagcaaggctgacttgctgctgttcacctgagcaatcaaattaacactgcttctgatttacctggggcctagcacataccaaggagcagcaggagctcaataaatgttttctgaaagtaattttgttttttttgagacagagtctccgtttgtcgcccaagccagaatgcagtggtgagatctcggcttactgcaacctcagcctcctgggttccagtgattctctggcctcagcctcccaagtagctgggattacaggcgtccgccaccacgcctggctaatttttgtatttttagtagagacggggtttcaccatgttggccaggctggtctcaaactcctgacctcaagcgatcagcctgcctcagcctcccaaagtgctgggattacaggcgtgagtcactgtgcccagcctaaggtaatttttttttttaagtaaagtccacagagcagtaataggcttggtttcatggactgggattagagtgagtgactagagtaagtaaacacaactgtggcatgtagagagacaaaggtagggaaggttatgtcattaatgtacctcaagtgtcactaaaaccatgtcagggctgcctgagttaccaatgtctgagctgagatgtgaggtctggttctgcaaacttagccttcgccaggtcaaccctatctagatcaagccccacgcagtcctccaatctctcaggaagaaagaagagaaaaaaatagaagcaaagagaaggggaagagggaagagagaaggggagggattgggttttaaatactcatctccccctataagtctccatctttattatctcaggtgcgtactctaaaattcctttactcttaagaacaagaaacttggccgggcgtggtggctcacgcctgcaatcctggcactttgggaggccgaggtgggcggatcacctgaggtcaggagtttgagaccagcctggccaacacggcgaaaccccatctctactaaaaatacaaaaattagctgggtgtggtggcaggtgcctgtagtcccagctactcaggagactgaggcaggagaatcgcttgaacccgggaggtggaggttgcagtgaaccgagatcatgccactgcactccagcctgggcaacaagagtgaaactgtctcaaaaaaaaaaaaaaaagaacaagaaacttttccttgggaatgctaagggctttttgtcaattgcttcaaaaggaggaatgtagtaaaacacatattataggactacatattttatatatatatatttttattatactttaagttcaagggtacatgtgcacaacatgcaggtttgttacatatgtatacatgtgccagggactacatattaacaatgatccctagcataatcaagtcgcaagatcttagataaggatgagaggaattcacatatatttaatggggtcagccacttacagaagcctcctctatgaaataaggtgcttcaggggtccccagactgcccacatgtatatagttgtactcatggctaaattttttacagtgaatggatatcagcaataggaaaggacctcaagtgtcactaaaagcatgtcagggctgcctgtagaaacccatgcacaggcttccttatgttctctccctcctgtgaggatatacatcaagcttgctccttgctacagcagcaaaatattcaatacatgtgtgcagtttgtgcccaggaaagtccattagagaatcagcaccctaagtttttaatttatgcaccaccagcctagccatcagattcccagaaggaaagcaggtattcaacataaatcatagtttgtaaaaaggatctaggcatagtgaaccatctttattactaatagttacaggattgaggaaagcattcaagtgcttatttcccagatgccagccaaaggccaactttgtaagcaggctcttgtaaaaacagcagccccagtgctgctctattcactcttcttcacagaagtgattagtaatagctaggcacagtggctcatgcctgtaatcccggcactttgggagaccaaggcgggtggattacttgaagtcaggagttcaagaccagcctggccaatagggtgaaaccccgtctccactaaatactaaatactaaaccccgtctctactaaatactaaaaaatttgcccggggtggtggcacacgcctgtagtcccagctactcaggaggctacagtggaaaaatagcttgaaactgagaggcagaggttgcagtgagccgagatctcaccactgcactccagcctgggcaacagagcgagactccctctcaaaaaaaccaaaaaagtgattggtaaatgttgccaatgagactgaagtacttcctaaagtaagtggcattagggagctgccaacctgtggctatggctgtgttccttgtaaaatataatctttttcttttttttttttttttgagacagttttgctcttgtcacccaggctgaagtgcaatggcgcaatcttggctcactgcaacctctgcctctcaggttcaagcgattctcctgcctcagcctcccaagtagctgggattagaggcacgtgccaccacacctggctaatgttgggtttttagcagagacagggtttcaccatgttggccaggctggtctcaaactccgacctcaagtgatctgcctgtctcagcctcccaaagtgctgggattacaggcatgagccaccgtgccccatcataaaatataatcttgacaactgaagcagttattactacaaagctaagaatgttgcaattacagaatgttctcgtgactagtgaacatggctgaagaagcaaattgagctcaaggtgcccttttctgagttactgagtggaaagggtgctaccactgctggagctgcaggaccagcttcttaaagatcatccaattcactgcattctcttctctctcctcccagaatccagcaatcagtcataagatatatttgttggctctcctgctaagaagcgaatgtgctgactagctagcatgagtttgattcaataaaacagcactacactccattagtcagactatctaatgataacagtgctcatacattaggtacccacgtgcctttttgttgctcttcacaatactcctatgaagtactaccttgtatttgacagaagatagcaaagtatcagagaagggaactgacctgtctagagtcacactagtgaaagcaagtgatacaggatttaaattcagaggttccattttccaaactcatgtcctttccattgcattgtactccctctttagctagaagtcaggttagcaccaatctgccgggaccttctcaccccgaaggtgcatgataaaatcaaatatgagaaccgacaaggccaaggaccaggtcactctgccaaaagtgcctaaaacagcctttcagcttcatccatcagcagacagccacaaaaccactcccaactgcagcaggctggtctccggtcaccactgtcttatcttgtcggaaaacatcctctctccatgtgccaaaaagttgagtgggaaaataattccatcctttcagagctaaacactgtgctgagtctcatcgcacacgggtgggcaaagaaagttgacatttactgctcacccactctgtgccttgacctgtgcaagatgctttatgctagaactcatttaattctcaagaacaacctcattttacagataaggatacagaggctctaagagttaaatttacccaagaggacatggtaagtaagtgccagtgcagggaacaaattcaggtcccactctaaaatctgtctctttccagatctcaaggcacaccactgagttgcctttcacctttctcccaagatgaggattgctctggcatgacttcacctttctcttctgaagcaattccaagttcacttctctgcccactgacagttcactctcctttccctgccactgtcccttctgcaaacgcacaatcttttacccaacctaacgcccccagcctcgtagaataacactgcgcagttggtttacagtcacaaagcactttcaagacagtgtttcgtctcctggtcaccacagtccggtgaagccggcaaagcagataaaagcatccccattttacaagaaagccatcttcccaaggtcgcggaataaaaagcaggtgaaatcggaagcagaaccccaggtcttgacccctggtcctcggctcatcccactgctccgcacagccgcccacgatccagcctccacctccgcgatgtcacaagatgctccctgggccagcagctcacatcccccacccccatcccacaaccacccacctgcagcggccctgcaggccccgccgacccttcccccacggtccctctctcttcaccagcccctcccactagggcctccttcccccgctagatccctccgctcaggcgccccctcccgcacaggctgccggcgagcccagcctcggcctcccacagaccctcgtcccgcctccacgcttcgtcaccccagcccctcctcctgtcagcccgcggcccagcccgccgacgttaccttctccaaggatgctggtctctgcaccgccagggagcgggccagtgacaggaccgtgttgaaatagaagccccgcgaggcgctggagccggagccggagcagccgccgccgcctccgcctccgcctccgcctccccgggccggggccgccgccatcacctcacgagccgcggcgctgcccgccggctccccgctcctggcccgcgagcgccc

SEQ ID NO: 1061 - DNA, 9681 bp, Homo sapiens
cgaggttcgggtcgtggggcggagggaagagcgggcgggcgggaggcgccggcgccagacgcggagggaaggagctacgagtagccgccgagaggccgcggagccagcgacgaccgacccagccgagccgccgccgccgccgcgcccccatggcggccgccaaggtgccgccgggcccaagcggggacagggtgggcgggcggggccggggccgttatcagcggccacgtgggcggcccgcgccgccgccaccaacctccgccggcctgcaggctcggccgtctgctgggcctcggtggcgcggagtcggggcgcgtggggtttgggggctcgaggcctgcggagttggggcgtttgggggtgcaggctctgcagaggcctgggggctgcagggcccccgcgtgaccttggggtgggttggggagcggccgtcgccacgcgggacggccccagcctccaggaactggtgcgggcggcgggtttcctccggctcggcccacttggggctccccactagtacggtgcatttattctttccgtcgcccacgcagcacttcattcattcggttcttacgtctggaaccgccactggcctctgtggcagaagctcgcgttccagcgtggggcacaggtcctagatgcgccgacccaggcggcggctttgttggctgcggtgtctggttgagtgcgggccgctgcagagccgcagtgctgtggggaacagtgaagagcagcgaaaagcttatgttttcttttccagtttgagtctagtggtgaagtcttgggtctcttacggacttctgggtgaccaaggcatgtgttctggaagactcgaacctaaaatatgattattggtgctctcttatcctctaaattgggccaggatttcatgactttcaccggtacaatttatctagttattaacttagttttctgaactgtgaaaaaattgctggcagagctgtgaatccagtgtaaatactagcagtcctgtagcgacttttttcgttttactaagcaagagcacaactatttcctaattagtcaaaactgaaagagttacattttgctttaaagtaatatttcaaaatctatttcgacccatcattgtgtcctttgatcttcacacagcaggtatcatctgcattttatggatgaggaagaaactgatgctcaaagagatgaggcagtttctgccaggccactctctgcaagtgttggcggcttgtagggtcccccatcagtctgtgcacagatctgattgatgtctgtgaatctgggggaggggccccaagttctggtgtctcactctgtgctcacatggagctgggcataaacgcagagctttcctagtgtggaagagtgggcctaatttcttgctttggggttgggcccatccttgtatctgaagtcccttcattgtcggagggctgaccactgcaggcactggttgggctctggttgtgagccagatccataggccagcagtgtaacctctttgtatctccacaggacactcatgaggaccatgatacttccactgagaatacagacgagtccaaccatgaccctcagtttgagccaatagtttctcttcctgagcaagaaattaaaacactggaagaagatgaagaggaactttttaaaatgtaagtaggctgatgtcccagaaataggactctttaaggttgaggttacaacttttatgggtgtccaggttttggcctgacttttaatcagactgaggctgcttaaagaaagggcctaaagttggtgactaatcccatgtggaaatttaacccgttcctttcatgaatcttcaccagatgcccttgctgccctgcagccagttgcatgaagggcatcccatcttgctgctctgtccactggcatggcggccccactgcccttttttgccactggcttctgaggatccagggagtcccttggttgagcagggggttttaagtttttgcagcatagacttctttggcatcgtgaagcttataaatcccccacccggtgtctgttgttgttgttgttttgagatggagtctcgctctgtcgcccaggctggagtgcagtggtgcgatcttggctcattgcaagctccgcctcccaggttcacgccattctcctgcctcagctggaactacaggcacccgccaccacgcccagctaattttttgtatttttagtagagacggagtttcaccgtattagccaggatggtctcgatctcctgacctcatgatctgcccaccccagcctcccaaagtgctgggattacaggcgtcagctaccgcgcccggcccacccttaatatacaacatgatgcttgcgataacacatgaaaataggtgatggtttagttattaaaaccacttaaaaaaattctgtacatgtgcttcttgacgctttcagttaagagctggctacagtggtgggtaccagccttgtgtcttgtgacagtgtcacagcaccacagagactgtggcctgtcgcctacactcaggattgcaacaaacatcatgtttagttacacacctcagtgaaaatgaggttgtagtttttccctgttcaagttcatggaatccccccatccttgaagttgctttaagagtccaggttaaggttttgttgctctggggtgggagagggaagcagagagagtcattcctactgtgagtttcctatccaaggaagggggccaggagggatacctgggaaaggagagctgtgtgtcaccctttggtcacagagggtgatggacatctccctgaaaccactgggtggccatggctccactctgctgatgcattgccgtagcccctgtttgggagtagctctttgctgtggtgaagtgcttgcctctgttccctcactgcccatgtcgggtgggaggtgctcctggtggcctgggcccaggcccttcctgagggaggtgaggccagcagggtgggcccgggtctttgcagtaaagctccaggggcatcctgttggggaaccctgtgagacagtctcttgccagaatcatgttggggcagagagcagagtcgtctgagagaggcaggcagagctgtgcacagagggagggcgccagcctgagccctgagtgcactgctggattctgggtgccctggtccccagcgggaggggctgctcctgggcaggagggccaggtgttggccagggcctgttgcctgattagaggcctgggcctcttctctgggtcatctgacctcagatgacccgcccgcctcagcctcccaaaatgctgggattacaggtgtgagccaccgcgtccggtcatctaattctcttggttgtggaagtggaattcaagatgacctggagttttttgggctgctgtgcttcctggtggtgtcgtgacagaggtccttggcctgcacctgatccatgttgtccctgcagatctctggggctggggtgctcttgcacagtgaccatgggacggagtcttgctctgttgcccaggctggagtgcagtggcgcgatcttggctcactgcaacctctgcctcccaggttcaagcaattttcctgcctcagcttcttgaatagctggggctataggcgcatgcctccatgcctggctgattttttgtatttttagtagagatggggtttcaccgagttagtcaggatggtctggatctcctgacctcatgatccacctgccttggcctcccaaagtgctggaattacaggcgtgagcccccgcgcctgctctctcttttttttttgagatggaatttcgctcttgctgcccaggctggtgcgcaatggtgtgatctcagctcgccgcaacctctgcctcccggcttcaagggattctcctgcctcagcctcccgagtagctgggattacaggcatgtgccaccacacccggctaattttgtatttttagtagagagggggtttctccacgttggtcaggctggtctcgaactcccgacgtcaggtgatccacccacctcagcctcccaaagtgtgggattacaggcgtgggccactgtgccctgttttgttttgtttttttttaaaatagggtctcactctcacccaggctggagtgcagcagtggtatcatggctcactgcagccttgaactcctgcgctcaagggatcctcctccctctgcctcttgagtagctgagactacgggtgttagccatcatgtccagctaatttttatctttttgtagagatagtgtcttgctatgttgcccaggctggtccccactgagggaaatattgtgactgtaggagcagtggggcaatctccactcactgtatcctctgcctcctgggctcaagtgattgtcgtgcctcagcctcctgagtagctgggattacaggcgtgcatcaccacactcagatgatttttgtatttgtagtagagatggggtttcaccatgttggccaggctggttttgaactcctaacctcagatgacctgcccgcctcggcctccccgaatgctgggattacaaatgagccaccgcgcccggtcgtctaattctcttggttgtggaaccggaattcaagatgacctggagtttgttgggctgctgcgctttctggtggtgttgtgacgggcagttcttggagcctgaagaagggctggggcgttcgtggaggcatggggtcctgcagtgcagagttgtcctgtgtcctcctgcgcaggccctgcatgtgggctgcaggtctgcactcttaacctcacggcttttcttgcaggcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacagtaggtggcatgaacgaccacctcgacagtccccagcagcttggcctgggacctttgggaagattcagggctgattgggaactggggagcgtgttatttcatggagtgcaagtttgtggtgtgtttgttgaatttaaaaccagaaatacgtttttcagacgtgcctctgaactcagagcaggcccgcagcgaagcttagagcacacgggggtgtggagtcagccagacgggccctgatgggaggacgcagcgcccaggctgggctcgggacgaggagtgagtgctgcagggcgagggggtgctgtgtgtgtgtgtgtgtgtgtgtgtgtgtgtgtgtgtgtggtgtctggggggtgggggttggtgtctggggggggttaatggggggtatgtgtagtatctagggggctgtggtgtctactggtggtggtgtataggggtgtgtggttcggtgtgtgtggtgtctggggcagggggctgtgtggtgtctgaaggtgtgtggtgtctggggcgggggttgtgtggttgggtgtggtgtttgggggtgtgtagttggtctggtgtctggggggtgtggtggggtatgtggttgggtgtggtgtctggcgggggtggttgggggtgtgtggttgggggtctggtgtctgggtgtttggtgtttggggtgtgtatgtggtgtctgggggtgtgtgtagtgtctgaaggtgtgtggtctggggggctgtgtggtgtctgaaggtgtgtcggggcatgtgtggtgtctgaaggtgtgtggtgtctggggaggtgtacagtgtgtggtgtctggggggcgggtgtggtatccggggtgtgtgtaggggtcatctggtgtttggtgtctaggggggtttgtggtgtctaaggggtgtggttgggtgtgtgtggtgtctgggggtgttggggtgtgtggtgtctgggggtgttggggtgtgtggtgtctgggggtgttggggtgtgtgttgtctgggggtgttggggtgtgtggtgttggggggggtgtgtggtgtctgggggggtttggtgtctgagggggtgcggtatcgcggtgggggtgtgtgtgagagagattgggggtgttcgggcagtgtaagagcagatgtgtgaggtgcccaggcaccagcctccccagttatggtgtgttctaccctcaccaggatcttcctggggaggaaacgggaggggaacggggctgagaaggtggccaggtcctgggcgcctctgaagctacataagtagaggcccttgggcaggttcagccaagagctccagccaccctgtgaggggtccagcctggcctgcaaagaagtggcagtaggttgtcctgagtatggctggctgccagctgtctttagattgaacctgcactgcccagcttgttggcatgtttggaagtacacttgtcctggggtgtcccttggtaagcttcctagtgtcgtttgctgagtgtcatgcgtgtccggcggggcagggtccctcatcccaggtgcaggatgactgctggcaggagcctgagtggctcagcccttgagggcgatgcagaggggtgggtggtggtctgcctatgccatgggcacctcactgcacggcctggcctgccagacttccttgggaactggctcctgggttcccctccctccctgctcagcatgtctagtcctggggaagcttgcactctggctggtcctcctcctcgagccgtttgaatcatttccttgggggtcttccctgatgccctgtgctgctcccagagcctgggtcaggttgtgggttgttgtgtgtgcatcataagttggttctgggctcctgggcatctgggcagagccatctgtgtagccagcagtgtcttgtgcccatcatgggcccttggtagacagggaaagtggcagtgggtagaggctggcttctgggtaaggtgtcgaagaggctgtgggctgggtcggggcggggtgtgaagggggcatgcagggggcttggcatccgctgtggcaggctgcagtagacgagacccccccccagctcccagttcagatagtgacgtgtaggggtatcctgggggtgcatgtggcctggactgggcatgggcacctgggatggtctgggttctcagggagctgttctgaagagtggtcacctgcagggccatctccccttggggctgcctgtgcctggggagttggggtggaggcgtccattgcaggccgtggctctgtctcctgtgccctccaggcttcagtcatggggatgcaggtgggcactcctgcatcaatcatggggatgcatggccacggcccccagtgggctcccttctggcaactgccccactttctagccttctgctgccccccactttcagataggctggctctatgtgttgggttcccttaggaaagactgggccccctgggccttgtgccctgatatctgaccctgggcttctgacttcacggccagggtcagaatcaaggggatcagggttgggcttgagtgcagccctgggatacagctggggcctgctttgccagctctgcttctctgcatttctggaggtgggggtctgtgtgccaagtgatcttgaacacagctcaggagctcctcgtggagatggccttacggtcagggaacaggtgcccattcctatttaggatggtcctggttttaagtgaatatggaggattttcaaagaggtttgaataaaactcaggcgccgtggtactttgtctaagcctggttctccaaccccagactgtccccgtgttgtctgaagcagacccctcaggttggtgagcagggtgctctgtggccgagggctgggtgggctggcctttgcagtcatctcaccatcttcacgagcttctctctcttcagtcacgccgatgatggagctgaagcccaacgcaggtagcgaccgtgcctgggtctggaacacccacgctgacttcgccgacgagtgccccaagccagagctgctggccatccgcttcctgaatgctgagagtgagccaagggccctggggacctgcctgacttggggctcacctgcgtggcagcgtggcgggttatgtgcaacaaatgctgttgccttttggggagagggggcagtaactgggaagtgtgtcgtgtgggctgccctgccctgctgtttgggggccatgcccagactgaagccatgagcagcgccttcccccttaaactcaaagctgtgccaagtagctggtgaacagcagtgcccgctcagccgccttgtggctggcactttggtttgctctccaagctccggttcccattagttgttgcggagcctgaggcccaacccagggcttcctcccagtgctgatcctcgtgccaggcttctggttcactggggccaggggcccctcatggttgcctgggtgccagcaggggctgggcagagagatccacaggcccaggctgatctcttccctgctcagaggtctttccagtccagatcgtccaagctgcgtccagtggctcctggaggagtcagtgggtactgtggcctggcgcctggtagctggccgtttggtgccaagtgaccttgtccttgctgtgggcgtggctgccccagcagcctttccaacacggttgggagccgagcctgtggcaaagaggcccatgccccttggttgcctgagggtccgtgctctaccgctctgcccaaatgggtgcagtcagatgaaggagacagaaggccagggccgatgtcaggtggaccagtcctttcttaggtcagcaattaccatgaaatgggtcttctgtgaatcctgactcttcagacccggcagggcatgtctcttccactgctcacagctcttaggaagtcttcgctctcccttccacagatgcacagaaattcaaaacaaagtttgaagaatgcaggaaagagatcgaagagagagaaaagaaaggtgacgtggtgccatgggttggggggcttctttgcagactcactctgcatctgactatacttccaggcgggtgctttttctgtctgccagataaacattccagggtgctgtggccgcctcacgtatccagagtgatgcagctccctggggacacaggtgcttcctggggagccctgagcacttgtcagtgttgctggcctcagtccaattgggcaggcattggagtccgggcactgcctggagctcaccagaaggtgctttatgatggtcctcggtttgtctctcagagggcttggtcacctctgccatgaggctggactgcagctgtggtggcaagtgaccagatgtcactgagcagcctgaccatggtctaggcagtgcttgagtgcatccacctggcttcctttcgtcactgaatttcaagaagacagactccaggaggcggcttggccaggcaggagtctgtcccgagggcgggcaagccgctgtgggtgggtgacggcacttgggaccagcctggcgagggccatgtgcttgaatgcaccgtgcttctgttttctcactgtgctgcttgtgtttttagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactc

SEQ ID NO: 1062 - DNA, 4888 bp, Homo sapiens
gggcgcctgcgacgccccgcctctggctcgggtgcgggagcggggcctgcccggactgcgacgccgccacagcttggggccagttcgcccagtcagggggatggctcggtcggcctcgggggtcgacgatcccccgggtaggcgacgtgccctgtccaggcctcacttcccgcgtccgcaaaacggggtggacaacgcagcctaaggcagagccgcgccaaggtccctcgctgtcgccgggctctggcggcctgaccgggcctggggtccgagcgtgcccccgggcctgggggggtcgccgcgatggactcgctggcagcgccccaggaccgcctggtggagcagctgctgtcgccgcggacccaggcccagaggcggctcaaggtgcgtgtgtggagagggcggaacgtgggtctgtgaccccgcgggctccgggactcggcatggggtccccgtccccgcgcgccacggcccgccagcgcctaggctcagcccttccctccgcagcggcctcgcaggtccgcggccccacggtggggcgacgtgccctgtccaggcctcacctcacgcgactccaaaacgcggcggagaatgcggccgtgggacccctccaggggccccaagggtctgcgggggctgggcgcctgggcgcgcgggcgggggaggctcggcgccgcggtctataaataggcgctgctccgccaccgccgctgccgccgcccccgcggctggatccgggccaggtggggcctcccgccccctggcactctccggaggggtgagtgtcgaggcccccagcttctccggcttatggagggccttgagtgtgtcccaggggtcccaatcctgctgccctctgcccgaggagggaggacatcgcctgtgcctgctgcggcctgacatctccccacggaataaatacagtgtcggtccctgcagagccctccctgggattggggccaggggtgccttctcctgccaccacctcgcctgccttcttatctccaggcttttgcccacgggccctccccttatttttgccaacgaaatgccccaccctgggaaccgtaccctctgctgtctcctcataccgcatttggtaagagacagggtattgggcttctggagaaacctttgtgtccctaccctgttccatcctgtccccaggacattgacaagcagtacgtgggcttcgccacactgcccaaccaggtgcaccgcaagtcggtgaagaaaggctttgacttcacactcatggtggctggtgagtgggccaggctcctcgggggagtggctggggtcactggccagccaagctctgtcgttggagccccagacctaacgcagctccttctctgtacctgtgtgcaggtgagtcaggcctggggaagtccacactggtccacagcctcttcctgacagacttgtacaaggaccggaagctgctcagtgctgagggtgagtggcccccaggaggccctggcactgatccccagtccccttccatgggacctctccaaggactccctttcaggtccagctcccactgttctgttctcgcggtgtgggtcccctgggggtagggccaaggcaccaagatggatgaggacgagggtcctggctgccaagggtgaggggctgagggttggagaggcccttccagtggccccttccccgtagagcgcatcagccagacggtagagattctaaaacacacggtggacattgaggagaagggagtcaagctgaagctcaccatcgtggacacgccgggattcggggacgctgtcaacaacaccgagtggtgagtgaggcctgctgagaaaggccttgcctaggcggccacagcactcgaggcctggcctcacctccctcctgcccacagctggaagcccatcaccgactatgtggaccagcagtttgagcagtacttccgtgatgagagcggcctcaaccgaaagaacatccaagacaaccgagtgcactgctgcctatacttcatctcccccttcgggcatgggtgtgtggctgtcctggggccaggctcgggagtgcagcccctacaatatggccccctggctgtgcctatgcccacccttggctgctctcggcaggctgcggccagtggatgtgggtttcatgaaggcattgcatgagaaggtcaacatcgtgcctctcatcgccaaagctgactgtcttgtccccagtgagatccggaagctgaaggagcgggtgagcctgccgtcgcacaggggcctggccagggccctggggctgagagtaccagggggacttgtctggcctcaaatctgatggtccttgccccaccacagatccgggaggagattgacaagtttgggatccatgtataccagttccctgagtgtgactcggacgaggatgaggacttcaagcagcaggaccgggaactgaaggtgaacatgcagactggtggggcaggggggatggagctggtgaggggcagaaccagagggctttgtctccttcacattgagcctgctggaggagggccaggtcagcccagttgggtgcaagagtcatttgttctaggagtagaggacctgtacccccttcatccagggctagaaggtaaaggtcaccatgtctttgcctggctggggtgggtcatgtgggccccgtgtggtgcttggcaggtatggagcacttgcccagatccagaggtgcagcagtgggccaggcccccaaccccaaccctcttcccatgggtcaccagaggaaggggctgccccagtggcacaccctggctcccagatttctgagctccagggttggtggctttgggtgccccggcagctagagtgatgatggagaccatgccaggggcaggtggccaccagggcaggggcatcagcatggggagacataggctcagccctggggagggaaggggcagctggagggggtggttcttgatgagggaggagatgaggagggagcatgcctggttgggcatagcctggaaaggccctggaatgtgagccacatgggctctggctccagccaggggcagagaggccagaaaggggcaacgccaggatctctttgaggagagatagttgatggtgatgctggaggggtgccccgggagttacatgcccgtttcccatcagtaaccgtgcaattacgctcaccgggtgtgagcctttctccctccttcccccaggagagcgcgcccttcgccgttataggcagcaacacggtggtggaggccaaggggcagcgggtccggggccgactgtacccctgggggatcgtggagggtgagtagagtcttggggtaccaggtctggtgggggaaggctgtcctgggccggcgccagcccactacccacccccaccccgcagtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccaggtgcgcgccccagccgcgagccagacctcgcccctctggccccgcccacgtctccataactgagggccggtcctgtcagcccacccagacttgaactttgcaccattccctaagccccccccctcccccagagcctggtctccctagaaccaagtccagggctgtgagggctccggagggcagggcctcagcagtggcggggatgggccaggcatcgccagcccacgctgagcctcccggtggcgccgccccgcccatcctcccccccgccccgcgcagcaaactgacccaggacagccgcatggagagccccatcccgatcctgccgctgcccaccccggacgccgagactgagaagcttatcaggatgaaggatgaggaagtatgtggggcggcgggggcggcggaggcgggcgtcagggatgctcctccgcggtgctgctcacccgccgggttgtctccgcccgcagctgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgca

SEQ ID NO: 1063 - DNA, 8859 bp, Homo sapiens
ggagcgggcggcggcggcggcggcgcggaggggccgctcaccccgcagcccggcctcggcctccgccgcttgtcgtcgcgccccgcccgcgagcccgccccgcacgtcccccgccggcggccaccatgagcacaggcctgcggtacaagagcaagctggcgaccccaggtgagcccagcgcctgcccgcgtgcccgcgcgcgcctttgtccccgccgcccgcgcgcctctcaccgtgtctctccgtctctcccccgcccgccggcccggacccgctcggaaccggacccggactcgaccccgaccccgaccccgcagaggacaagcaggtacgtgcgcagcgccgctcccccgccgggagacccggccggctgtcacccattgtgacactagcgccttgggcgcccaggcgcgaccccgcccccgccggccctcacccagccctgtcgcgatcaccgattgtcagccgggcagtgccgccgcgcctggggcttcagaggagaggagtgggggccctggtccccggacccgcacagcagggaccctgcgcccctccccaggatggggggatgggcagagtgtccccctcccacagggccagtgccagcatctcctgctgacctggcctgtaggccatgagctgggggtcctgggtgaggccatggtcgtggcaggccacgctgggggaggggagtcaggctccatcagccagcacagtccctgaacagccctacagcagagggcctgtggtcaccacccacctcccctgcaccttcatgcccctttccctccccatacacaaatttgagtgttcaggtctgcaacagggactcttccccagattgggaacccccagggtctggtctgagtcattctgggtgcccagatgggtcctgggaccctgtgggtacaaataggcttgtggcttctcaaaagggttggccccaccctccaggaaagcaagactggacaggaggctggtctaggcacctgggtgaaacccagccgagctcagggttaaacaatgctgtgaggcccctggggtggggcgggggctgacaaccaggtgggctgggggggctggggaaagcctgctggtgtcctctctggcttgagctcagccatctttggaggaaaaaagaagagcccaattctggcaccagggtggcactggcagcccccatcagggatggagtttctcaggagccatggatgctgagtggaactccagagtcctggcccagggtgcagcaggcagggcaggagggcgggcaggggggccaggagctgggggagtcactggctgaccagtgccattctcctggaagggacacaccccacccagaggtggatgaggctctctgggaggggccccttggggagccaggctgggagctgcctccccatcacagcaggtcagacaaagcctgagatgcagggacacatgcgtcaggctactgtttgagggaaatggaaggaactgaggctgggaaagccaggaggccaggcccctgaggcttctcctgtgcctgcaggtgtccccagcttgacccaagggcactctgagaccctgggctccagccactgctgttgggtgcagccaggttctcttgcccattactgcagggtggggaccccctcctgctgaggtgcccatcgtttgaggtcaaccgggagtccacctcaccccatcccaggcctcccaggcctccaagcccagaggaagaaggcactgtgtggccaaggaagggagccccggagcaggagccaggccaggtgtctgggtgaccagtgggtctgggggagctggaagcacatggcagcttccctgctaccaccgttgctgagcctcagcctgtccaagcattctttttgctctttgaaagggggctgtagaggcattgggggagttccgtcactacgctctgtgcccccacctcctcacaggcagcaccggtgatctcttggccctggctgctgctcccagagctgactcgggtgattctaagaatggaagtgccagagaggctcaggcattgggaggagatgggcgcagctgtgtcatatggctcaggaagccctgggagtatcttttgtcacttggggaccagagaaagggggtggcaggtacggccccttccttgaggctcccccagggaatccacaggccctgactgggccccagtgggtggcagggcaggtgggttgaacgctgagagtgagattcttgccctcctgacctgggcctccccagaggctgtgccttaccaatggggaaactgaggcaggcagtctgagagccacacactctgttagacacctcctagcctgaggcctaggcccagggctgtctgtcttcctggagatgccctgggcctgagatgccagcctgtctgggtgggtgctgggcttcgaggtgtggaccctcagttggaaactgggtgggactcagcctagaggcttcctgcaggtcagggccatggaaggctggggccagtgaggaggctttctggcagcaaggactgagggatgcactggtagagctggggggcctggagctgccccctttccctgggatgaaaggctctcctgttcccagctgtgggcctgcccctcctccccaggtgccagtggtccaggccccacaacaggaccagggcctggacaggaagtggaggaggtctctcagccaggagagcctaagggagggctggtggcgggtggggtggggtggggttggggcctccagcttctaatgttctaatgtgcaggggcttggcctgaccagtcctaccctggaacctttccaggccccatgtcctgctccgctgggcttgcctgttgggattctactggggtcatggaggtgggtggcccacagagcggagctcgggagacccccgcagtccctggagtagccacatgggagggaggcccggctggcaggagctcccagtccctccaatcctgtgggtcagagctggtgaggatgctcagagggcaagggaatgtccacagaagcacgtgggagatgggtcccatcccacccccacccctgtctctgagggcagggccacctgagggctgcagggcagcgcatgggtggccggcgtttattcagcaggctggcgggggcttccaagttttgcagggacctccagtactccggcagcctgcacccttcctttcccttcccttcccttctgtccaccctaagcctcctaggggacaggcaggctggacttcagaaaaggtgggctctgccctcctccggtcccccgaatgtcttgggaaagagtccaccaaacacacatgcacacacccgcgcacacgcacatacccaatgcatgcacacacgtacacacacacgcatacacgcatgtatacacgcgcacacacgcaggcattacacacacacacattacacacacacacccgcacggacgcgcacacacaaacgcgcgcacgcacgcacgcacgcacgggggaggtcagccccaagcagggctggggaggggtgcagggcgcggcgtgtctgtgggcacttggggcgtcgagacgccgccgggaggttttcgggcaagtctgcgagaagacggcgggccctgaactgggcgggtacccgcgctgttgcgcgtgggtcccgggagcggcctccggcgccctctggcgggcggaagccgcgcagcacctcttgggggcgggacgcgcggtggctaccgactcccggcccgccccggcccgcgtgcaggacccggtcgtcccctcctgctgtcctggagcccggactgaggccccgggggcgcggcagggctcccggtccacgcgagccatggcccgaccgcgcctcggctcagccctgccctccgcagccgctttcgggtggctccgcccgcggcccaatttccaggcgaccgtttcccggcgacggcgggcggggccgtctctgccgccccccgccgcgcgctccgcgggcgcctgcgacgccccgcctctggctcgggtgcgggagcggggcctgcccggactgcgacgccgccacagcttggggccagttcgcccagtcagggggatggctcggtcggcctcgggggtcgacgatcccccgggtaggcgacgtgccctgtccaggcctcacttcccgcgtccgcaaaacggggtggacaacgcagcctaaggcagagccgcgccaaggtccctcgctgtcgccgggctctggcggcctgaccgggcctggggtccgagcgtgcccccgggcctgggggggtcgccgcgatggactcgctggcagcgccccaggaccgcctggtggagcagctgctgtcgccgcggacccaggcccagaggcggctcaaggtgcgtgtgtggagagggcggaacgtgggtctgtgaccccgcgggctccgggactcggcatggggtccccgtccccgcgcgccacggcccgccagcgcctaggctcagcccttccctccgcagcggcctcgcaggtccgcggccccacggtggggcgacgtgccctgtccaggcctcacctcacgcgactccaaaacgcggcggagaatgcggccgtgggacccctccaggggccccaagggtctgcgggggctgggcgcctgggcgcgcgggcgggggaggctcggcgccgcggtctataaataggcgctgctccgccaccgccgctgccgccgcccccgcggctggatccgggccaggtggggcctcccgccccctggcactctccggaggggtgagtgtcgaggcccccagcttctccggcttatggagggccttgagtgtgtcccaggggtcccaatcctgctgccctctgcccgaggagggaggacatcgcctgtgcctgctgcggcctgacatctccccacggaataaatacagtgtcggtccctgcagagccctccctgggattggggccaggggtgccttctcctgccaccacctcgcctgccttcttatctccaggcttttgcccacgggccctccccttatttttgccaacgaaatgccccaccctgggaaccgtaccctctgctgtctcctcataccgcatttggtaagagacagggtattgggcttctggagaaacctttgtgtccctaccctgttccatcctgtccccaggacattgacaagcagtacgtgggcttcgccacactgcccaaccaggtgcaccgcaagtcggtgaagaaaggctttgacttcacactcatggtggctggtgagtgggccaggctcctcgggggagtggctggggtcactggccagccaagctctgtcgttggagccccagacctaacgcagctccttctctgtacctgtgtgcaggtgagtcaggcctggggaagtccacactggtccacagcctcttcctgacagacttgtacaaggaccggaagctgctcagtgctgagggtgagtggcccccaggaggccctggcactgatccccagtccccttccatgggacctctccaaggactccctttcaggtccagctcccactgttctgttctcgcggtgtgggtcccctgggggtagggccaaggcaccaagatggatgaggacgagggtcctggctgccaagggtgaggggctgagggttggagaggcccttccagtggccccttccccgtagagcgcatcagccagacggtagagattctaaaacacacggtggacattgaggagaagggagtcaagctgaagctcaccatcgtggacacgccgggattcggggacgctgtcaacaacaccgagtggtgagtgaggcctgctgagaaaggccttgcctaggcggccacagcactcgaggcctggcctcacctccctcctgcccacagctggaagcccatcaccgactatgtggaccagcagtttgagcagtacttccgtgatgagagcggcctcaaccgaaagaacatccaagacaaccgagtgcactgctgcctatacttcatctcccccttcgggcatgggtgtgtggctgtcctggggccaggctcgggagtgcagcccctacaatatggccccctggctgtgcctatgcccacccttggctgctctcggcaggctgcggccagtggatgtgggtttcatgaaggcattgcatgagaaggtcaacatcgtgcctctcatcgccaaagctgactgtcttgtccccagtgagatccggaagctgaaggagcgggtgagcctgccgtcgcacaggggcctggccagggccctggggctgagagtaccagggggacttgtctggcctcaaatctgatggtccttgccccaccacagatccgggaggagattgacaagtttgggatccatgtataccagttccctgagtgtgactcggacgaggatgaggacttcaagcagcaggaccgggaactgaaggtgaacatgcagactggtggggcaggggggatggagctggtgaggggcagaaccagagggctttgtctccttcacattgagcctgctggaggagggccaggtcagcccagttgggtgcaagagtcatttgttctaggagtagaggacctgtacccccttcatccagggctagaaggtaaaggtcaccatgtctttgcctggctggggtgggtcatgtgggccccgtgtggtgcttggcaggtatggagcacttgcccagatccagaggtgcagcagtgggccaggcccccaaccccaaccctcttcccatgggtcaccagaggaaggggctgccccagtggcacaccctggctcccagatttctgagctccagggttggtggctttgggtgccccggcagctagagtgatgatggagaccatgccaggggcaggtggccaccagggcaggggcatcagcatggggagacataggctcagccctggggagggaaggggcagctggagggggtggttcttgatgagggaggagatgaggagggagcatgcctggttgggcatagcctggaaaggccctggaatgtgagccacatgggctctggctccagccaggggcagagaggccagaaaggggcaacgccaggatctctttgaggagagatagttgatggtgatgctggaggggtgccccgggagttacatgcccgtttcccatcagtaaccgtgcaattacgctcaccgggtgtgagcctttctccctccttcccccaggagagcgcgcccttcgccgttataggcagcaacacggtggtggaggccaaggggcagcgggtccggggccgactgtacccctgggggatcgtggagggtgagtagagtcttggggtaccaggtctggtgggggaaggctgtcctgggccggcgccagcccactacccacccccaccccgcagtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccaggtgcgcgccccagccgcgagccagacctcgcccctctggccccgcccacgtctccataactgagggccggtcctgtcagcccacccagacttgaactttgcaccattccctaagccccccccctcccccagagcctggtctccctagaaccaagtccagggctgtgagggctccggagggcagggcctcagcagtggcggggatgggccaggcatcgccagcccacgctgagcctcccggtggcgccgccccgcccatcctcccccccgccccgcgcagcaaactgacccaggacagccgcatggagagccccatcccgatcctgccgctgcccaccccggacgccgagactgagaagcttatcaggatgaaggatgaggaagtatgtggggcggcgggggcggcggaggcgggcgtcagggatgctcctccgcggtgctgctcacccgccgggttgtctccgcccgcagctgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgca

SEQ ID NO: 1064 - DNA, 7555 bp, Homo sapiens
gttctaatgtgcaggggcttggcctgaccagtcctaccctggaacctttccaggccccatgtcctgctccgctgggcttgcctgttgggattctactggggtcatggaggtgggtggcccacagagcggagctcgggagacccccgcagtccctggagtagccacatgggagggaggcccggctggcaggagctcccagtccctccaatcctgtgggtcagagctggtgaggatgctcagagggcaagggaatgtccacagaagcacgtgggagatgggtcccatcccacccccacccctgtctctgagggcagggccacctgagggctgcagggcagcgcatgggtggccggcgtttattcagcaggctggcgggggcttccaagttttgcagggacctccagtactccggcagcctgcacccttcctttcccttcccttcccttctgtccaccctaagcctcctaggggacaggcaggctggacttcagaaaaggtgggctctgccctcctccggtcccccgaatgtcttgggaaagagtccaccaaacacacatgcacacacccgcgcacacgcacatacccaatgcatgcacacacgtacacacacacgcatacacgcatgtatacacgcgcacacacgcaggcattacacacacacacattacacacacacacccgcacggacgcgcacacacaaacgcgcgcacgcacgcacgcacgcacgggggaggtcagccccaagcagggctggggaggggtgcagggcgcggcgtgtctgtgggcacttggggcgtcgagacgccgccgggaggttttcgggcaagtctgcgagaagacggcgggccctgaactgggcgggtacccgcgctgttgcgcgtgggtcccgggagcggcctccggcgccctctggcgggcggaagccgcgcagcacctcttgggggcgggacgcgcggtggctaccgactcccggcccgccccggcccgcgtgcaggacccggtcgtcccctcctgctgtcctggagcccggactgaggccccgggggcgcggcagggctcccggtccacgcgagccatggcccgaccgcgcctcggctcagccctgccctccgcagccgctttcgggtggctccgcccgcggcccaatttccaggcgaccgtttcccggcgacggcgggcggggccgtctctgccgccccccgccgcgcgctccgcgggcgcctgcgacgccccgcctctggctcgggtgcgggagcggggcctgcccggactgcgacgccgccacagcttggggccagttcgcccagtcagggggatggctcggtcggcctcgggggtcgacgatcccccgggtaggcgacgtgccctgtccaggcctcacttcccgcgtccgcaaaacggggtggacaacgcagcctaaggcagagccgcgccaaggtccctcgctgtcgccgggctctggcggcctgaccgggcctggggtccgagcgtgcccccgggcctgggggggtcgccgcgatggactcgctggcagcgccccaggaccgcctggtggagcagctgctgtcgccgcggacccaggcccagaggcggctcaaggtgcgtgtgtggagagggcggaacgtgggtctgtgaccccgcgggctccgggactcggcatggggtccccgtccccgcgcgccacggcccgccagcgcctaggctcagcccttccctccgcagcggcctcgcaggtccgcggccccacggtggggcgacgtgccctgtccaggcctcacctcacgcgactccaaaacgcggcggagaatgcggccgtgggacccctccaggggccccaagggtctgcgggggctgggcgcctgggcgcgcgggcgggggaggctcggcgccgcggtctataaataggcgctgctccgccaccgccgctgccgccgcccccgcggctggatccgggccaggtggggcctcccgccccctggcactctccggaggggtgagtgtcgaggcccccagcttctccggcttatggagggccttgagtgtgtcccaggggtcccaatcctgctgccctctgcccgaggagggaggacatcgcctgtgcctgctgcggcctgacatctccccacggaataaatacagtgtcggtccctgcagagccctccctgggattggggccaggggtgccttctcctgccaccacctcgcctgccttcttatctccaggcttttgcccacgggccctccccttatttttgccaacgaaatgccccaccctgggaaccgtaccctctgctgtctcctcataccgcatttggtaagagacagggtattgggcttctggagaaacctttgtgtccctaccctgttccatcctgtccccaggacattgacaagcagtacgtgggcttcgccacactgcccaaccaggtgcaccgcaagtcggtgaagaaaggctttgacttcacactcatggtggctggtgagtgggccaggctcctcgggggagtggctggggtcactggccagccaagctctgtcgttggagccccagacctaacgcagctccttctctgtacctgtgtgcaggtgagtcaggcctggggaagtccacactggtccacagcctcttcctgacagacttgtacaaggaccggaagctgctcagtgctgagggtgagtggcccccaggaggccctggcactgatccccagtccccttccatgggacctctccaaggactccctttcaggtccagctcccactgttctgttctcgcggtgtgggtcccctgggggtagggccaaggcaccaagatggatgaggacgagggtcctggctgccaagggtgaggggctgagggttggagaggcccttccagtggccccttccccgtagagcgcatcagccagacggtagagattctaaaacacacggtggacattgaggagaagggagtcaagctgaagctcaccatcgtggacacgccgggattcggggacgctgtcaacaacaccgagtggtgagtgaggcctgctgagaaaggccttgcctaggcggccacagcactcgaggcctggcctcacctccctcctgcccacagctggaagcccatcaccgactatgtggaccagcagtttgagcagtacttccgtgatgagagcggcctcaaccgaaagaacatccaagacaaccgagtgcactgctgcctatacttcatctcccccttcgggcatgggtgtgtggctgtcctggggccaggctcgggagtgcagcccctacaatatggccccctggctgtgcctatgcccacccttggctgctctcggcaggctgcggccagtggatgtgggtttcatgaaggcattgcatgagaaggtcaacatcgtgcctctcatcgccaaagctgactgtcttgtccccagtgagatccggaagctgaaggagcgggtgagcctgccgtcgcacaggggcctggccagggccctggggctgagagtaccagggggacttgtctggcctcaaatctgatggtccttgccccaccacagatccgggaggagattgacaagtttgggatccatgtataccagttccctgagtgtgactcggacgaggatgaggacttcaagcagcaggaccgggaactgaaggtgaacatgcagactggtggggcaggggggatggagctggtgaggggcagaaccagagggctttgtctccttcacattgagcctgctggaggagggccaggtcagcccagttgggtgcaagagtcatttgttctaggagtagaggacctgtacccccttcatccagggctagaaggtaaaggtcaccatgtctttgcctggctggggtgggtcatgtgggccccgtgtggtgcttggcaggtatggagcacttgcccagatccagaggtgcagcagtgggccaggcccccaaccccaaccctcttcccatgggtcaccagaggaaggggctgccccagtggcacaccctggctcccagatttctgagctccagggttggtggctttgggtgccccggcagctagagtgatgatggagaccatgccaggggcaggtggccaccagggcaggggcatcagcatggggagacataggctcagccctggggagggaaggggcagctggagggggtggttcttgatgagggaggagatgaggagggagcatgcctggttgggcatagcctggaaaggccctggaatgtgagccacatgggctctggctccagccaggggcagagaggccagaaaggggcaacgccaggatctctttgaggagagatagttgatggtgatgctggaggggtgccccgggagttacatgcccgtttcccatcagtaaccgtgcaattacgctcaccgggtgtgagcctttctccctccttcccccaggagagcgcgcccttcgccgttataggcagcaacacggtggtggaggccaaggggcagcgggtccggggccgactgtacccctgggggatcgtggagggtgagtagagtcttggggtaccaggtctggtgggggaaggctgtcctgggccggcgccagcccactacccacccccaccccgcagtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccaggtgcgcgccccagccgcgagccagacctcgcccctctggccccgcccacgtctccataactgagggccggtcctgtcagcccacccagacttgaactttgcaccattccctaagccccccccctcccccagagcctggtctccctagaaccaagtccagggctgtgagggctccggagggcagggcctcagcagtggcggggatgggccaggcatcgccagcccacgctgagcctcccggtggcgccgccccgcccatcctcccccccgccccgcgcagcaaactgacccaggacagccgcatggagagccccatcccgatcctgccgctgcccaccccggacgccgagactgagaagcttatcaggatgaaggatgaggaagtatgtggggcggcgggggcggcggaggcgggcgtcagggatgctcctccgcggtgctgctcacccgccgggttgtctccgcccgcagctgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccggtgagtctggagtccggtcgggcccccggctgctccctaggccgacccgggttgagaggagctctggtcgtttggctgcagctgggagagacttgggtcagacttagaggggacttccagccggcgtgcggggtggtcagggtggagaggctggcgggctaccgggacgccgggcatcaggggctggatggagccgggccggcagtctgggtactcagagatgtcgcccaggtgcccgccgaccgctcggcttactgcggcgcttcccttgcagggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctggtct

SEQ ID NO: 1065 - DNA, 6306 bp, Homo sapiens
cgggagcggggcctgcccggactgcgacgccgccacagcttggggccagttcgcccagtcagggggatggctcggtcggcctcgggggtcgacgatcccccgggtaggcgacgtgccctgtccaggcctcacttcccgcgtccgcaaaacggggtggacaacgcagcctaaggcagagccgcgccaaggtccctcgctgtcgccgggctctggcggcctgaccgggcctggggtccgagcgtgcccccgggcctgggggggtcgccgcgatggactcgctggcagcgccccaggaccgcctggtggagcagctgctgtcgccgcggacccaggcccagaggcggctcaaggtgcgtgtgtggagagggcggaacgtgggtctgtgaccccgcgggctccgggactcggcatggggtccccgtccccgcgcgccacggcccgccagcgcctaggctcagcccttccctccgcagcggcctcgcaggtccgcggccccacggtggggcgacgtgccctgtccaggcctcacctcacgcgactccaaaacgcggcggagaatgcggccgtgggacccctccaggggccccaagggtctgcgggggctgggcgcctgggcgcgcgggcgggggaggctcggcgccgcggtctataaataggcgctgctccgccaccgccgctgccgccgcccccgcggctggatccgggccaggtggggcctcccgccccctggcactctccggaggggtgagtgtcgaggcccccagcttctccggcttatggagggccttgagtgtgtcccaggggtcccaatcctgctgccctctgcccgaggagggaggacatcgcctgtgcctgctgcggcctgacatctccccacggaataaatacagtgtcggtccctgcagagccctccctgggattggggccaggggtgccttctcctgccaccacctcgcctgccttcttatctccaggcttttgcccacgggccctccccttatttttgccaacgaaatgccccaccctgggaaccgtaccctctgctgtctcctcataccgcatttggtaagagacagggtattgggcttctggagaaacctttgtgtccctaccctgttccatcctgtccccaggacattgacaagcagtacgtgggcttcgccacactgcccaaccaggtgcaccgcaagtcggtgaagaaaggctttgacttcacactcatggtggctggtgagtgggccaggctcctcgggggagtggctggggtcactggccagccaagctctgtcgttggagccccagacctaacgcagctccttctctgtacctgtgtgcaggtgagtcaggcctggggaagtccacactggtccacagcctcttcctgacagacttgtacaaggaccggaagctgctcagtgctgagggtgagtggcccccaggaggccctggcactgatccccagtccccttccatgggacctctccaaggactccctttcaggtccagctcccactgttctgttctcgcggtgtgggtcccctgggggtagggccaaggcaccaagatggatgaggacgagggtcctggctgccaagggtgaggggctgagggttggagaggcccttccagtggccccttccccgtagagcgcatcagccagacggtagagattctaaaacacacggtggacattgaggagaagggagtcaagctgaagctcaccatcgtggacacgccgggattcggggacgctgtcaacaacaccgagtggtgagtgaggcctgctgagaaaggccttgcctaggcggccacagcactcgaggcctggcctcacctccctcctgcccacagctggaagcccatcaccgactatgtggaccagcagtttgagcagtacttccgtgatgagagcggcctcaaccgaaagaacatccaagacaaccgagtgcactgctgcctatacttcatctcccccttcgggcatgggtgtgtggctgtcctggggccaggctcgggagtgcagcccctacaatatggccccctggctgtgcctatgcccacccttggctgctctcggcaggctgcggccagtggatgtgggtttcatgaaggcattgcatgagaaggtcaacatcgtgcctctcatcgccaaagctgactgtcttgtccccagtgagatccggaagctgaaggagcgggtgagcctgccgtcgcacaggggcctggccagggccctggggctgagagtaccagggggacttgtctggcctcaaatctgatggtccttgccccaccacagatccgggaggagattgacaagtttgggatccatgtataccagttccctgagtgtgactcggacgaggatgaggacttcaagcagcaggaccgggaactgaaggtgaacatgcagactggtggggcaggggggatggagctggtgaggggcagaaccagagggctttgtctccttcacattgagcctgctggaggagggccaggtcagcccagttgggtgcaagagtcatttgttctaggagtagaggacctgtacccccttcatccagggctagaaggtaaaggtcaccatgtctttgcctggctggggtgggtcatgtgggccccgtgtggtgcttggcaggtatggagcacttgcccagatccagaggtgcagcagtgggccaggcccccaaccccaaccctcttcccatgggtcaccagaggaaggggctgccccagtggcacaccctggctcccagatttctgagctccagggttggtggctttgggtgccccggcagctagagtgatgatggagaccatgccaggggcaggtggccaccagggcaggggcatcagcatggggagacataggctcagccctggggagggaaggggcagctggagggggtggttcttgatgagggaggagatgaggagggagcatgcctggttgggcatagcctggaaaggccctggaatgtgagccacatgggctctggctccagccaggggcagagaggccagaaaggggcaacgccaggatctctttgaggagagatagttgatggtgatgctggaggggtgccccgggagttacatgcccgtttcccatcagtaaccgtgcaattacgctcaccgggtgtgagcctttctccctccttcccccaggagagcgcgcccttcgccgttataggcagcaacacggtggtggaggccaaggggcagcgggtccggggccgactgtacccctgggggatcgtggagggtgagtagagtcttggggtaccaggtctggtgggggaaggctgtcctgggccggcgccagcccactacccacccccaccccgcagtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccaggtgcgcgccccagccgcgagccagacctcgcccctctggccccgcccacgtctccataactgagggccggtcctgtcagcccacccagacttgaactttgcaccattccctaagccccccccctcccccagagcctggtctccctagaaccaagtccagggctgtgagggctccggagggcagggcctcagcagtggcggggatgggccaggcatcgccagcccacgctgagcctcccggtggcgccgccccgcccatcctcccccccgccccgcgcagcaaactgacccaggacagccgcatggagagccccatcccgatcctgccgctgcccaccccggacgccgagactgagaagcttatcaggatgaaggatgaggaagtatgtggggcggcgggggcggcggaggcgggcgtcagggatgctcctccgcggtgctgctcacccgccgggttgtctccgcccgcagctgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccggtgagtctggagtccggtcgggcccccggctgctccctaggccgacccgggttgagaggagctctggtcgtttggctgcagctgggagagacttgggtcagacttagaggggacttccagccggcgtgcggggtggtcagggtggagaggctggcgggctaccgggacgccgggcatcaggggctggatggagccgggccggcagtctgggtactcagagatgtcgcccaggtgcccgccgaccgctcggcttactgcggcgcttcccttgcagggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctggtct

SEQ ID NO: 1066 - DNA, 13626 bp, Homo sapiens
atgaccttggctgctttcatctctgaagcgccacttctcagaaacacagaggtaagttgggtttctaatgtttctgctgattataaattatttttggtgtttacggataggcaactggttcatttttctagcaaactaagaattcagaagctttctacactgttttagaagtgggaaatggtttcatttttcagtgtgcctattataaaattgtgtcagttccattgttgggagagttgacaaacttagaataggagctgtggaatagatgaaaatattgtacttatattaaattaatcgaattggataactgtcctgtgattatgtatgagaatatccttgctcttgggtattttccctgaagtattagtattaaaggttagaggggccgggtgcagtggctcacgcctgtaatcccaacactttgggaggccgaggcgggtggatcacgaggtcaggagttcaagaccagcctgaccaacatggtgaagccaagtctctactaaaaatacaaaaattagctgggcgtggtggcacgcgcctgtaatcccagctactcaggaggctgaggcaggagaatcgcttaaacccgggaggcagaggttgcagtgagcggagatcgtgccactgcactccagcctggacaacagagttagactccgtcaaaaaaaaaaaaaaaaagaagaaaaaagaaaaaatgttagaggaacaagatataggagacctactctcaaatggtctagaagaaaaaatgtgtatgtgcatgcctgtgagaacacacacgtacgtacacacacacacagataatgacagggcaaaggttccaaaattttaaacctggtaaatctcggtacgggtatacaggagttgttctactacactattctttcaacatttttggaagtttgaacttacttcaaaataaaaagttttccaaactttaggcagttacttctctcccattctgcctgctctgttgggcctggagaccatacaccaggagggatgacggtttatcaagtgttatgctctgatgcgtgactgaaaaggccaacccagctctggcaattagcaagaaagcacaatatgaagttcccaggaaaaaaaaaaagcaaaacaaacttttgaatgatttatctttaaaatatattgtttctcttcaaacagtaatctggatttaatcacaacctagtgatagtttttaaacgtcttctacaatgtttgttatactaaatagcaaaacatcaggaagatttaccttcagatctttaatttcaatccataaaagatatcagagatattttctccttcctctggtaagggaatgacgaaaactatttttggctttttatcagataatgtgggaacagggtataagaagtttccaaatataacttctgaataccgggataaaacatgcatgtctttactctgccactctatctggcctcagatacgttttcctgaatgcttatttattcaagttggtttttgttttgttctttaaccttatttttatctgagaagaaaacattttccccctttgttccttcttcttttggctttcttttttaaaatagagatgaggtcttgctatgttgctccagctggtcttgaactcctgggctcaagcgatcctcctgccttggcctcccaagatgctaagattacaggtgtgagcccctatgcctggtcttcttcttcttgatcttagccaaaaggccaagaagtgataagaggaggacacttgaagtgtagttgggcaaggagccttctaccagctgcttactttctttgttcctgacttttaaaagtgtgttgctattgatacacagtctcctgatatgtaaaatgctgggaggatgaagctaagttactcaaagtgccattcagaaactgggcccagttctatttgcagctacatacattagaaatcatttctagaggctgagcatggtaactcatacctgtaattccagcactttgggaggccaaggcaggagaattgcctgagctcaggagtttgagacctgtctgggcaacatggtaaaaccccatctttaccaaaaacacaaaaaattaactgggtttggtggcacacacctgtggtcccagctacttcaaaaggctgaggtgggagggtctcttgagcctgagaggaacaggtggcagtgaaccaatattgtgccactgcactccagcctgggtgacagagtgagaccccgccgtctcaaaataaaaataaaaagaaatcgtttctagaaactgttttcccgtgtgtaaactagtggcactgcagcctgaggcaggtgctgagatggggacctggaaaaggcaacaggcattttgagtcagaaacaatgtgactttcctgctccaaaatgtgcaattcaaaagtctttcttagttgtgactaaaacaaactttgaacttactatttcaacagtattataaggggaagacccaaggaatgggactggcactgggaaaacagctaggaagctgctctgcacggccagggagtctggaagcatcctggtactccagagcgaacaaggctgagcgcttgatgtggggcttagaggcttaaccaacttggttcgaatctagccactgccacttattagtgacagtgacgaaaggctcagtctcctgatatataaaatgttgggaggatgaaactaagttacacgaagtgccttatacagcgtgtcaggcatccaacagaggccattatcaacattaaccacactgacagcatttcaagcagagtatccgaacagttaccccatcttcaggcctactgagttcaaatatttgcttaacaagagcagccagtaactcttacctggcctcaactggcagcagatattctgggcctcaaatatctatctaataggaaatggtcacagacacaaaataagcttaacaaaaggcagtttttttttgttttttttttgttttctgttttttgagataaggactcactctatcccccaggttggagtgcagtagtggcgtgatcacggctcactgcagactcaagtgatcctcctacttcagcctctcaagtagatgggaccacaggcgtgtgccatcacaccaggctaattatttttcttttcttttttttttttttgagacggagtttcgctctttttgcccaggctggagtgcaatggtgcgatcttggctcaccacaacctctgcctcctgaattcaaacgaatctcctgcctcagcctcctaagtatctgggattacaggcatgcgccaccacgccggctaatttttttgtattttttgtagagacagggtttctccatgttggccaggctggtctcgaactcccgacctcagatgatccgcccacctcggcctcccaaagtgctgggattactgacctgagccaccgcacccagcctatttatttaatttttcacagagatgaggtcttgctatgttgcccacactggtcttgagctcctgggctcaagtgatcttcctgccttggtctcccagtgttgggattataggcgtaagccacagcgcctggccggcagttctttctggggtgattagaagttgggaccatgtattacctgtctgagtcagcattataaacacctatggtcactgtcctggcaaaacatggaatcatcaaagctcatctaaccagagtgcagttaataaccaggaagtaagcaagagaaagacaaaggatttggcagtcaaaacagatttgacaggccaagtcagatcctcctctgaacgagtcagaggaacaaataaagacaggattgccataatgcctctgtgctaaaagcttatcttgtttacttaaataaagggagtgcccctcaggtcttgagtaagagcttgctgacatcaccctcacacagactttatctcttgtttctaaccctgtgttagaagcagtaacacagaagatttagttgctcctgacagcagtgggagctattgtctaagagatacaaaggagaaaaaagtatacctgcagcaagtgatatcacctctggggctgccaccacatcacctcactacgccctgagggggtctcagcactagacaagttccaaatcttttgcaaattaaacaaccccaggtcaggcgtggtggcttatgcctgtaatcccagcactttggggggctgaggtgggtggatcacctgaggtcaggagtttgagaccagcctggccaacagagcaaaaccccatctctactaaacaaaatacaaaaattaaccaggcgtagtggtgtgcacctgtagtcccagctacttgggaggctgaggcaagagaattgcttgagtccaggaggccgaagttgcagtaagccgagatcgcgccactgcactccagcctgggtgacagagtgagactccatttcaaaaaataaaaacaacaaaagccaattacaacaacaacaacaaaaaaacaacgaattaaacaaccccaaagattgcacaaatttcaagtatctttagaatatgttttcagaaagcctggcccatggacatttttcaacagcatctccattgcaaaggtggaatggtgtgagtcacacaggcatggctgagtcccactaatgcacatcccttctaggtactctccaatcaccagccccaggtgcccactcaagcccagctcttagtgaggtttccctgactctctgggcacttccactcctaccacacagggtagagccacacccctttccgtacccccatgtgctctggcagcattattttgagagccttcgctttactgcacgtctgtcccatctgtcccctgactggtccatgagcccctggtgggaactttgtctctggtaactaaacactgtctggaggtggtggacaaggtgtctggagaaaaacaaactcctccctgggatgcctgagctcccaggattctagaaggttagttttgcaaacctttaaagaagggattttcatcaaggggcccacagatccttcattgaggtttatgagtcccacatcaaaggttgggtgtctatctacatcagattctcttaaagtccatgatcctaaaacagttaagaactaatgctgtgagggcctcttcctgggtcaaagccacagggaacctgccatgtggatgctgcagcggggtgtggatcagccaggccgcctttcactgtgttctgttttccctcccagctttagctccgccaaaatgaaacactcattaaacgcacttctcattttcctcatcataacatctgcgtggggtgggagcaaaggcccgctggatcagctagagaaaggaggggaaactgctcagtctgcagatccccagtgggagcagttaaataacaaaaacctgagcatgcctcttctccctgccgacttccacaaggaaaacaccgtcaccaacgactggattccagagggggaggaggacgacgactatctggacctggagaagatattcagtgaagacgacgactacatcgacatcgtcgacagtctgtcagtttccccgacagactctgatgtgagtgctgggaacatcctccagctttttcatggcaagagccggatccagcgtcttaacatcctcaacgccaagttcgctttcaacctctaccgagtgctgaaagaccaggtcaacactttcgataacatcttcatagcacccgttggcatttctactgcgatgggtatgatttccttaggtctgaagggagagacccatgaacaagtgcactcgattttgcattttaaagactttgttaatgccagcagcaagtatgaaatcacgaccattcataatctcttccgtaagctgactcatcgcctcttcaggaggaattttgggtacacactgcggtcagtcaatgacctttatatccagaagcagtttccaatcctgcttgacttcaaaactaaagtaagagagtattactttgctgaggcccagatagctgacttctcagaccctgccttcatatcaaaaaccaacaaccacatcatgaagctcaccaagggcctcataaaagatgctctggagaatatagaccctgctacccagatgatgattctcaactgcatctacttcaaaggtaagaggcacctttacagttctcacagcaaacccacaacatactatttttgtatgtgggtagattgaatgccaagaactgtactgtagctataatttatccaggaaaactagacacaagattgactctggaacggggacagggaaggccaagctgaagtgacagtagcatctgacacttactgagccctaactctgtgctttaacacagccttgtgaggtcatcactgttattagcatccccattttacagaggaagccaccaacacatgaagtaaaaggatgggctgggcgcggtggctcacgcctgtaatcccagcactttgggaggccgaggcaggcagatcacttgaggtcaggagttcgagatcagcctgaccaacagaccaacatggtgaaaacctggctctactaaaaatacaaaaattagctgggcctggcggtgggtgcctgtactcccagctacttgggaggctgaggcaggagaatcacttgaacctggaaggcagagattgcagtgagccgagactgtgccactgcactctagcctggacgacagagtgagactccatctcaaaaaaaaaaaaaaaagaagtaaaacgatgctccaagggcacccagttattaaggggcagagccaaagctgaacccagggaggccaaccctagcaatctgttaaattggaagaaataatacaaaaactgttttagcatttggccagcctggatttgagttttctcttttcctttcccaattatcaataagcaggaatatagacaaaaggctaaagaaatgcacctgtgaactattcagcttgagcagctgacattgacacctacaagtgcttttcaggatacttttgaactactgggcaggtgggatggagaaataaattactatttccccagcaactgttctgggctgagcacaagggcactttttaaggaggtcaccccacacccatcacacacacataggacccctggaatcctaggaataaataagcatggatttgtaaaatccaaacctctcttttcaaatatcctcacctggaccagaccagaagaaacctctactttactctctaagctgagagtgtggaaggggaaacacgaggaatggttcggcttcaggactaattgcggtgacacacaaccacttctctttgccaccaaggactaccaggtacctgcaaagggcagtacttggaggccagtgctttctgctagttagctcccgtggttttatagcagcccaggcgaaggaaggagaccccccccagctcctggcttctgttcagggaaagggggccagagcccctcctgatctgtccacacacctgctctgtgccttggctgaggcccctgcagctctacaaggcaggcattctgctggataggccaagcagggtcactctgacacccaggtttccaccccaaggcatggcacaatgctggcctcctgtgggtggaatcaaaggctgagttctaacaggcttgcggcagacacacacacagagaccacatgtacatgatgaacacacatatccttttcattacaggttattagtacaagttttggaattgagcaaacaagagtctaagcgctggtttcaccacttctcgtttgtgtgacctcagacaagtcattcaacatctctatgactcagtttccttatctttatcacagagatgacacccactctgacagggccgagggaagaaccataagcgatggcaatgcaacagagtggcacatgacaagagctcagcgaatttgagggaatgaaactgtagattacaatactagtacaatatgataaacatatgatattgttagtgacatttattttacttctactagcaaataacctatgtttaggactgactttagaacaggctggcagaagcatttttggcagcatcaaagtcctccaacctactggtctgttggagccccccaagtacaccaaagagcctctgcattagccctggctgagggttcagggacaggcagagaagtacagcagtgagccatccctgcctgcatggaggtggagaaatgatcaggcatggtcagttgacaatctcctaaacacagtaacccgtgtcataccacagtgtaaacacacgtgcaaatgcttctgcttcctttccccatcatgagaatagtcactcaatgccgggcatcacaagggatcaaatgctaggagtacccaatcattcatggatgcttctcaaaggggacgagtgtctagaagtgtaattttaatttcacttaatttcatatggaatcatctccattactaattttgttctaattttaatgtgataatcactttgtaaagcacaataaacagaggcaggctctcatgaggaagtcagaaggaaagaatcccaagagacatgggacagctccatccaaactgaaagggccgtgattcccaaaagagcaattttgtccccaaggtctgaagacacttttggttgtcacaacctggggggttggagtaagcattactggtatctagaagggggaggctggggatgttgctaaacaccctaccatgcacagggcagcccacattgccacaaactattatgtggcccaaatgtcaaaaatgctgaggttgagaaaccctgggtgaggcagactcagggagaagggaatcgagcttcactcacaggcaggcaggagctgtctggtacttcaacctccaagacacctcctgctcatctcatcctggctgctctacccaccagctagaaaccttgaacaagttacttcacttctttgtgcctctgtttcctcatatgtaaaagagggataacaaaacgcacacaacttgcatgttgctaggagcagaaatgagataatacaggaaaggtgctgagaagaatgcccggcacatggccagttctcaactactagtcacccattactattagttactcacatcttagagctaacatagacatgggcttattcctggatacacagcactgtccccatatctacagtggtgatcctaagggcaacatggcatcacccaaatgtcttgttagtcactacagaatcacagtgtgagggatgaaggccatcaagacagagctgaggctggcagggtggctcatgcctataatcccagtgctttggaaggctgaggcaggaggattgcttgaggccaagggtttgagaccagcctaggtaacatagcaagaccccatctacaattaaaaaaaaaaaaaaaaagacagaaagaaaaaatagccaggcgtggcatgtgcttgtagtccaagctactggggagggaggctgaggcagaaggattccttgagcctgggagtgtgaggctgcagtgagctatgatggcatcgccgcactccagcctgcatgacacagtgagacctggtctcaaaaaccaaataataataacagtaataaaagctggaaagagctcaaagttactcatttgacagatgtgacagatgaagaaatagaagcgagttaggtgccttaccatggtcaaacaactagttcgtatcagaccctactccagaaactattccagtccgggtaacctctcgttaacctctcttgttagaaatgcaaatttctgcccaaatcaggcctcaggaatcaagagactgtggggtcggctctgcaggctatctgaatgaggcctccagggaaatcagattcactctcaagggtgagacgatttccctaaaggaaccttctcataacagcctcttcctgtggcctttacaggatcctgggtgaataaattcccagtggaaatgacacacaaccacaacttccggctgaatgagagagaggtagttaaggtttccatgatgcagaccaaggggaacttcctcgcagcaaatgaccaggagctggactgcgacatcctccagctggaatacgtggggggcatcagcatgctaattgtggtcccacacaagatgtctgggatgaagaccctcgaagcgcaactgacaccccgggtggtggagagatggcaaaaaagcatgacaaacaggtatttcacactgtgtgtttgttcttttgagctcccagatgctgggggtgtctgggaatactggaaaatggatcatttttttaaaaagggagaattatgtacaagtacccaagaacttccatacagggccactctgttaattcagccccaatttgttgcttgagataagagatgattagagagcattcataagggacacatctgccctctaggggccagtttcagaagttagaggcagatgacttagagacagcttggtgcttgctttgtggcttcgagtcccagcttcatcatccctaaaatgggtataattccattacttccccgggtcacttgagaaaataacagaatcagcgatgctgagcgcccctcccagtacttggaacctaggaggcactcaaaaaaagattggctcaactcttccctgcccaggaaattccaaggtcctcttagcctaccgaggacacatcattcatgatttcctctattattattcgttactttgtagttaaaactgcaggtgttaagtacttattgagattattattgggtcatggcagaaagaatggagaggtcttatttctgtcttactggatactggctaggcccatatgaagaagtgattctggtttgaacctccttataggacaagaatacaaacatatgcaaccaaactgagaaaagtaggctctcagaggaaggtatttgcccgggtagccagtcatcatgctctgtgaatttttccttaacaacgtcccttctgtacctgcctccttccattcctccctgcagcccggcagctcttgagaaagggactgcatcttttttttttttttttttttgagacagggtcttgttctgtcacccaggctggagtgcagtggcatcatcatggctcactgcagcctcaacctcctgaacttaagtgatcctctcacctcagcctcctgaatagttgagactacaggcgtgcaccttcatgcccagctaattaaactttttttggtagagatgaggtctcgctgtgttgcccaggctggtcttgaactcctggcctcaagcagtcctcctgccttggccttccaaagtgctgggattaacaggcgtgagccgctgtgcctggcccatttgacttttaattgagatcttacttggtgcaaggtatgagctaggtaaaagagtgaagaagatcaagccttcctgcccatccagctgggattgcaccttaaatctctttatcccctgcaaagtgccagactaactccacaggcactactgttgctatccgcccccttagggattgagtaagttgaggcaaagattgagaatattcagcattgtctagtatatacaggaaaggttctttttaaaagtacactaccagatattcgactccttaattacaaaaaaaaaaccaaatgcctaaaattgggaaaccaaaccagagaattattttagatgcctttttaaaccataaaccaggaaaagttctgctgctaaccttgaagataggaaacgaaccatacagtctcaaggaaataatcatgcaacagaaaacacacctcagttttcagtagcggaattacaaaggagtgtgcttcctaaaatcctcaactgacagtcccggaatataaattttaataagtgctatatcaattctgtgataaatataacccgtggccctttaaagggaaaatcatgattcttttgtaacttgtggttcaataaaactgggcccccctttccttttctgtctagaactcgagaagtgcttctgccgaaattcaagctggagaagaactacaatctagtggagtccctgaagttgatggggatcaggatgctgtttgacaaaaatggcaacatggcaggcatctcagaccaaaggatcgccatcgacctggtaaccactcccttgtccacccccgacccgtccccagggtctgcctcagcacagccccacctccacttgcccttcctacccaccccccaatctcatgtcccagcttggggtgctgagtctgctcttcggcctgggtgggatacacagaatgcctagtttcatggatgccagctggagagcacggcacctggcagacacttactgggcaggggggatcccaagagcagccatggggtgagccccactcccgctgacaccagagacaggggagacatgtgctgcggtctgggaaatagctacccccagccaaatcatgaaagagccattaaacaccgcactatacacatacttaacttaaaccaatcgggcgctcagcaaaagagagagaacaccagtccaaacagtgcagcagacccagttccccatcccggagaagtgcgcagcagtgtggggagctggagctggggtggctgtcctgcaccagcccccacgaccctcagaccacaggcactgccaagagggaacatgaacctagccggcctctaagtgcaacggctgcccctgacaggtggtgacagatattttcaagagtgactctgaccagctgtgatttccaccttacatgttgtctttggatcctttccctgaatgatatgagattgtgctgggaactctagccctctgtgtgctgacctccagaatctgacaactttcctttccaaacagttcaagcaccaaggcacgatcacagtgaacgaggaaggcacccaagccaccactgtgaccacggtggggttcatgccgctgtccacccaagtccgcttcactgtcgaccgcccctttcttttcctcatctacgagcatcgcaccagctgcctgctcttcatgggaagagtggccaaccccagcaggtcctagaggtggaggtctaggtgtctgaagtgccttgggggcaccctcattttgtttccattccaacaacgagaacagagatgttctggcatcatttacgtagtttacgctaccaatctgaattcgaggcccatatgagaggagcttagaaacgaccaagaagagaggcttgttggaatcaattctgcacaatagcccatgctgtaagctcatagaagtcactgtaactgtagtgtgtctgctgttacctagagggtctcacctccccactcttcacagcaaacctgagcagcgcgtcctaagcacctcccgctccggtgaccccatccttgcacacctgactctgtcactcaagcctttctccaccaggcccctcatctgaataccaagcacagaaatgagtggtgtgactaattccttacctctcccaaggagggtacacaactagcaccattcttgatgtccagggaagaagccacctcaagacatatgaggggtgccctgggctaatgttagggcttaattttctcaaagcctgacctttcaaatccatgatgaatgccatcagtccctcctgctgttgcctccctgtgacctggaggacagtgtgtgccatgtctcccatactagagataaataaatgtagccacatttactgtg

SEQ ID NO: 1067 - DNA, 3208 bp, Homo sapiens
tgcaacaggatccggtttattctgccttggcagggtggtcctgagagtggtgggtgccaccctgtccggggcggagagagggcccgagggccagttaaggccaatggcgggagaagcagggggctgcagcccctggaatgcggtgaagccaggccgaggcccggaggcagctgtggtaggccagggcagggtggaaggcaccggactgggaccgggccagggctacagggccgaggacccaggccacacgggcaccccgggaggcggggcacagggtcacgtgacacagaacatgaaacacaggcacagggtcataggccagatgcacatccagccatggctgggccagacactgggacacagtggtggtgtcacacacagaccacaggggggacacatggatttgacagccacaatgcacagaccaggctacagagctcgagggacgtgggaaggggccttttggcactactgcactggaatcgtgagacaaaggtagcaggacactctggcggtgcctggggcggtccccttgcggcctctctaggcttagtccgtcttccacactttgttgagcagcttcaccacttcatcatagatgacaaacactatggccacatccaggcagacccggcccaggcgggggacagtgcccttgtagaatctgggtgggaggaggggcggggagaggaaggcaggtcagcacagtgtccctgcacagggcaatccccagatactgaagtgagaggcacagaggcctgaaggggacagagtgggcaggccaggtaggccgggaaaggtttgaggtggggacaatagccctgcccctcccccactcacgccttgagcccctccttcttcaggatctgcaagccgcagtcccacgtgttccggtatttgtgcgcctccaggccctatgggggacatcagcaggcaggggctcagcagctagctctggcctggtccccccttcccctccccttcccggccccaccacctgcatccgggtcttaatcacatccagaggagtgtttccaaagacactggctgcgcctgcaatagctccgaagaccccagtgatcagagggttcatgggcttgttggggttgtcccctggatataggaggggtgaggtgggtcagagggtgccgggaggggcctggatcagcacttcaaaaggtgggtgcccgccacccaggggtggccccaaggagaggagaggagctggccatgtgcagagatggggccctgtgatgcagacacacctcggtaccagttgcgcagggaggtcatgacgaagaagcggatggcctggttcgagccctgcttcaggacagtggctgtgaggccctggtacgtccccttcagccctgcgggaaggcaggcacggggttaccctgcagcctctcaggccccggttgggaattggtgtgtgtggggggtgggtgttgcacaaagcccaaggcaggatgggaggtgcaggcccttcccaccctggcccaggtccctgagccctatcaggaaggtcgagtggctcaccttgttcccgcacaatctccctaaccccgtggaagaatcctctgtacttggggtttggggaggtctggtcgtggatgaacttcacctgagagagagaagcaaaggcgcaggttctcggctgccacctgggtgggtcctggctagctggcaggcccagggcccatccagggtggagggaactgggaactcttccccaggaagcagtgcagccaaggccgccctgggctgcccacacggaccatgccccgggacacagggcagcccacacggaccatgctctgggacacagggcagccctgtgagcagcctctccctttatgtttgctgctcttttccagttttggcagtgaaggtgtcattttgttttctgctttataaaagtattttttaaagactttaaggctgcctttagcatagactcagcctccacgggtggcccttcgtggcaggcgtcctgccccagggccccgcggtcaccccgccggccttccctggcgtccaggagaccctccccagcttgccggttgccccgggagcaccgggccagcggggccgcccgtctccgtactccctgcgtgtccggggtcctcgccaggaccttccccaccttgatggtctccatggggcacacgaccaccacggcctcggccacgccagcgcccaggccgcacagcagcccacgcgtgctgtccagccgtccctgggcatcccgcatgtggttgctgaggaactcgaacattccaaacctggaggcgggaggcgggtgagaggggctgccgcggccgagcccccctcccgcagcagccaccggccgggcctcacctgacggccgccttggggatggaaccgtagagcagggagctaaggccgcggtacaggcccaggacgccatggctgcgaaccgtctgccgcacgcagtcccctgggggagggggcggtcaggaccccacggccctcggtgccgccgccctgggtacccgccccccgcggcgccgcggcctccccctcctcaccgatgccccggtaccgcggcgggtgcgagcgctcgtccagctgcagctgcgtcttcacgtactcggtggggaaggtgatgcagatctcgatgccacccgccaggccgcctgcagggaccgggaacccgctcctgagactcccgcccggccgctggcgctcgggcccctcccccgtcccggacttcggtcggcgcggccgccgcgccagtgccgcggggaacataggctggggccccacgcccccatgccctcaccccgttgtcccggcgaggcgcagggggtgacagacgggaggcgggcgagtcccagcgcgccgggtggggaccaggaccgcgcctccacgactccccagcccacggcccaacccggaagtggggcggggcctcagcgtcccgggcccacccagaagcgcggcgggagaggggtccgcgtcccggaggggcccacctgccaggatcgccttccccgggtgcgtcagcttggccttcccggacgcgggcgcggcggccgccagagcgcgcggggcgcggggcgcgggcatggcgggcgggaggcggggcgccctgtggcggcttcgggtccgagactccagaactccgcgctcggtccgcggtggcggcggcggccggttatggtcccaggggcggggcggccgc

SEQ ID NO: 1068 - DNA, 2941 bp, Homo sapiens
tgcaacaggatccggtttattctgccttggcagggtggtcctgagagtggtgggtgccaccctgtccggggcggagagagggcccgagggccagttaaggccaatggcgggagaagcagggggctgcagcccctggaatgcggtgaagccaggccgaggcccggaggcagctgtggtaggccagggcagggtggaaggcaccggactgggaccgggccagggctacagggccgaggacccaggccacacgggcaccccgggaggcggggcacagggtcacgtgacacagaacatgaaacacaggcacagggtcataggccagatgcacatccagccatggctgggccagacactgggacacagtggtggtgtcacacacagaccacaggggggacacatggatttgacagccacaatgcacagaccaggctacagagctcgagggacgtgggaaggggccttttggcactactgcactggaatcgtgagacaaaggtagcaggacactctggcggtgcctggggcggtccccttgcggcctctctaggcttagtccgtcttccacactttgttgagcagcttcaccacttcatcatagatgacaaacactatggccacatccaggcagacccggcccaggcgggggacagtgcccttgtagaatctgggtgggaggaggggcggggagaggaaggcaggtcagcacagtgtccctgcacagggcaatccccagatactgaagtgagaggcacagaggcctgaaggggacagagtgggcaggccaggtaggccgggaaaggtttgaggtggggacaatagccctgcccctcccccactcacgccttgagcccctccttcttcaggatctgcaagccgcagtcccacgtgttccggtatttgtgcgcctccaggccctatgggggacatcagcaggcaggggctcagcagctagctctggcctggtccccccttcccctccccttcccggccccaccacctgcatccgggtcttaatcacatccagaggagtgtttccaaagacactggctgcgcctgcaatagctccgaagaccccagtgatcagagggttcatgggcttgttggggttgtcccctggatataggaggggtgaggtgggtcagagggtgccgggaggggcctggatcagcacttcaaaaggtgggtgcccgccacccaggggtggccccaaggagaggagaggagctggccatgtgcagagatggggccctgtgatgcagacacacctcggtaccagttgcgcagggaggtcatgacgaagaagcggatggcctggttcgagccctgcttcaggacagtggctgtgaggccctggtacgtccccttcagccctgcgggaaggcaggcacggggttaccctgcagcctctcaggccccggttgggaattggtgtgtgtggggggtgggtgttgcacaaagcccaaggcaggatgggaggtgcaggcccttcccaccctggcccaggtccctgagccctatcaggaaggtcgagtggctcaccttgttcccgcacaatctccctaaccccgtggaagaatcctctgtacttggggtttggggaggtctggtcgtggatgaacttcacctgagagagagaagcaaaggcgcaggttctcggctgccacctgggtgggtcctggctagctggcaggcccagggcccatccagggtggagggaactgggaactcttccccaggaagcagtgcagccaaggccgccctgggctgcccacacggaccatgccccgggacacagggcagcccacacggaccatgctctgggacacagggcagccctgtgagcagcctctccctttatgtttgctgctcttttccagttttggcagtgaaggtgtcattttgttttctgctttataaaagtattttttaaagactttaaggctgcctttagcatagactcagcctccacgggtggcccttcgtggcaggcgtcctgccccagggccccgcggtcaccccgccggccttccctggcgtccaggagaccctccccagcttgccggttgccccgggagcaccgggccagcggggccgcccgtctccgtactccctgcgtgtccggggtcctcgccaggaccttccccaccttgatggtctccatggggcacacgaccaccacggcctcggccacgccagcgcccaggccgcacagcagcccacgcgtgctgtccagccgtccctgggcatcccgcatgtggttgctgaggaactcgaacattccaaacctggaggcgggaggcgggtgagaggggctgccgcggccgagcccccctcccgcagcagccaccggccgggcctcacctgacggccgccttggggatggaaccgtagagcagggagctaaggccgcggtacaggcccaggacgccatggctgcgaaccgtctgccgcacgcagtcccctgggggagggggcggtcaggaccccacggccctcggtgccgccgccctgggtacccgccccccgcggcgccgcggcctccccctcctcaccgatgccccggtaccgcggcgggtgcgagcgctcgtccagctgcagctgcgtcttcacgtactcggtggggaaggtgatgcagatctcgatgccacccgccaggccgcctgcagggaccgggaacccgctcctgagactcccgcccggccgctggcgctcgggcccctcccccgtcccggacttcggtcggcgcggccgccgcgccagtgccgcggggaacataggctggggccccacgcccccatgccctcaccccgttgtcccggcgaggcgcagggggtgacagacgggaggcgggcgagtcccagcgcgccgggtggggaccaggaccgcgcctccacgactccccagcccacggcccaacccggaagtggggcggggcctcagc

SEQ ID NO: 1069 - DNA, 32210 bp, Homo sapiens
ggagttcgcgcgacgaccgcggggtcggcgggcggggcgaggccctggacggcggcggcagtggggctcctccttctgtttcccagaccgagagccgcgccggcaccatgtcagcttaccctaaaagctacaatccgttcgacgacgacggggaggacgaaggcgcccggccggccccttggagggacgcccgagacctccccgacgggcccgacgcgcccgcggacaggcagcagtacttgcggcaggaggtcctccgcagggctgaggccacggccgccagcaccagcaggtccctggccctcatgtacgagtccgagaaggttggggtcgcctcttccgaggtgagcctggggcagggctggtgtggactcgccggtctctgtgctgtcaaacggagacgagaaatgttttgctcacaatcttttgagaattctcaagttgcctagcatagattcttgcaccttagtgactcgatggtggtaacaatctgttaactatgtaaaggtatgtgcatctggagtacttgaagagggcagtttaccccagaaatcttccttagctattagtctgcttcgttgattttttttttcttacgcctagctcacggggaaacgccagattattttctgtccaggtgagtaaaaattctgaacagcaggtcctaggtttgggaaatggagagtccgtttcttcgacattatttcctgtgcaaaatctggcacagggttttggccattccttccggagtgagccagaaagagaggactatgtgcctgcgagtgtcaggtgataccctgaagcatcagggcaggtggtccacgagttcttcccgcatcattgacatctccacctaaccaaccaatagaggtattgaagtcccttcagcccagacagctgcctagttgaccaaagcctgggtttgattgagtccagggtcttacctttacttcccaaatcctagacaaatagtgtgcgggttaagagtttgttgctccaactcatcttcatcagttcttcccatccttagatttcagagagtagtaccttcaataacaattattctggccgagcgcagtgactcacgcctgtaatcccagcactttgggaggcctaggcgtcggatcgcctgagctcaggagttcgagacccgcctgggcaacatggtgaaaccctgtctccactaaaattaaaaaaaaaaaaaaactagccgggtgtggcggtgcgcctgtagtcgcagctactcaggaggctgaggtaggagaatcgcttgtacccgggaggcagaggttgcagttagctgagatcgtgctgctgcactccagcatgggcaacagaccgagatcctggagggtctttttctttttcttttttttttttttttgagatggaatctcgctctgtcgcccttgcttgggtacagtggcatgatctgggctcactgcaacttccgcctccgggattcagacgattctcctgcctcagcctcccgagtagctgggactacaggtgcgccgccacacccggctaattttttttgtatttgtagtggagacagggttttgccccgttggccaggctggtctggaactcctgacctcaggcagtccgcccgctttggcctcccaaagggctgggattacaggcgtgagccaccataccggtcgagaatgattctttattgtacaccacagtctctcttcagcctgctaatgaaacagttttgtttggacagagaaaaaaaaaggtttaaaaaaatgtataagccaggcgcggttgtacttctgtaatcccaacaatttgtaaggctgaggtaggcagatcattttagcccaggagtttgagaccagcaggggtaactgcgtctctacaaaatttgaaaaattagccaggcatggtggcacacacatgtgagtgcagctactgaggaggctgaggcaggaggaccgcttgagcccaggatgtcaaggttgcagtgagccatgttcataccactgcactccagcttgggcgacagagcaacacgctatcatttccccttgctgttttcttgggttaattcccttccccacctctctctgttcatgtatccctcattgatccacctccctgtggttttttttttttttttttgagacagattctcgctctgtcaccagactggagtgcagtggcaccaacttggctcactacagcctccgcctcctgggttcaagtgattctcctgcctcagcctcctgagtagctgggactaaggcgtgcactaccacacccagctaattttggtattaatagagttggggttttgccatgttggccaggatggtctcgatctcttgacctcgtgatccaccacctcggcctcccaaagtcctgggattataggcgtgagccactgcacctagcccacctccctgtgtttaactgttggttttttatttttgttttgtttgagacaaagtcttactctgtcacccaggctggagtgcgatggtgtgatctcggctcactgcaacctccacctccccagttcaaatgattctcctgcctcaacctcccaagtagctgggattagaggcacctgctacaacacctggctaatttttttgtttttgtttttgtttttgtttttttggtgttttttgtttttgagacggagtcttgctctgtctcccaggctagagttcagtggcgcgatctcagctcactgctacctctgcctcccaggtcaagcgattctcctgcctcaacctcctgagtagctgggcttacaggcacccgccgccatgcccagctaatttttgtatttttagtagagacggggtttcactgtgttggtccggctggtcttgaactcctgacctcatgatccacctgccttggcctcccaaagtgttgggattacaggcgtgagcgaccacacctggcctctgatttttgtatttttagtagagacaggtttcgccatgttgggcaggctggtctcaaacgcctgaccttaggtgatctgcccacctcagcctcccaaagtgctgggattacagatgtgagccactgcgcccggtcctaaccttgttagggaggttttgcctgtagttcttacatctcatacctactggattcctatgttccattctaaatgggaagtcttggcttagatttgagaggattgcctgaggttttagggccctggtgaatgggtcacatgattgaggatctcaagcccaaggaattcaactaacaactatttaaggagacatctttgtaaactgagaacaaatgaagtagggaatcaatgattcaaagtagggcattgtggcagaggataaacttgaatctagcttttaaggctgaggtttacacaagaggagtgagaatgagggatgttcttagggaagacaggaaaatatgcaaatgcactggcccagcaacagagctcctgggtccagaggagggacatgatagactgggtgtgttagaggacaggggatggaggaggtagcttaggagcccttggaggtcatagggaaagttctggtctcatagcgcaggagaggcaaaaatgtaatagtggtgagtttgatatagattgtgatgacatgccccgtgctgcccccaaaggtctttctatgcagtggggacagtgagagctgaggcagagtggcacttcaggcatatcaggcttggccaggccaggcattgctgtgagaagtacagtgtggtcatgactgggcaggtgacaggtgctcttgtcagtgagacaacatgttggaattttccaggattgggtcagttctcaattatgagaagccctgggagtcagggatgacctacatctccaccacacccagtgttctccaagctgtctttgtttttgtgttttgttttgggggaggttttttgagatgggggtctcactctgtcaaccaggctagagtgccgtggtgcaatcttggctcactgcagcctctgcctccaggtgcaagtgatcctcctgccacagcctcccaagtagccaagactacaggtgcacgccaccacactcgactaatttttggtatttttggtggagatgggctttcgccatgttacccaggctagtctcgaattcctgagctcagatgatctgcacaccttggcctcccagtgctggattacaggctccaagctgtctttgaatcactctaatcactctttcattccctttggtgttgggatgggaacagaggagtatgagctcttccaaccctcagtgcacagtgtggcttccagcaaattccagcataccctgctaatcacccaacttaggtgcctggttaccccagcactgtgaaacatgccaacacatgacagatttatgtcaaagatgaggactttacaaattatattaggttgggaagattataattcagtcccagcttggcaggaaaatggcttagttaagtcacctctagcaaagagagctgcccttctcctactgtgaaacctggcaaggattgtttctcacaaaggctcaggccacaggctatgaccacaaaagaacagaggagaagtagtgggagcagggcggtttccccaggccgacctggtaggcgctttgtagaactacagggagacttgtaagccactcgtctctttccctgtttagtaagcatgatttcttcttttttttttcctaaggtttaatttttatgaagagagattccaatcacatggttcaaaatttcaaaacatacaaaagggtgtagtcttctcccacttccctccctatcatccctctgcccctaaggcagccaggcactttccctccttcagtgttttggggagataatgccgtggataaaaatgggtttttttttttaagtgaagtattgtatacattctggtctgcatgtgcttaatagaatggagtttgttccacactagtatgtaatgagctgggctttctttttggctgtgttgtattccattgaacaaatgacttctatttatgcagcctgtcccctaatgatgagcattgaggttgtttacaccttttggtgagtctatttgcatcctacttggacatggtttttgtacaccttttcatcactccagtggaggagactcacctgcccaggacactctgcttcccctcttgtagctgaacttaactccactgaggttttctggggcccgagatctcggttcaggggagtccagcaacaaacattagaccagggttggaacggctggcacagtaacatcaatggaaagggacagagtttgagagttcaaacgtgatgcactcagcagccaccgccagcacatcctccacaccgtctcgtgcaggggcccacccatctctgtgtctttccagcacacaacagtcacccacactgggcattccattcagaggtgggagagaggaggacacccctcctggcccaggagcagaggccatcaaggtgtccccggaacttagagtagatacattgccaaaaggtgatatcctcattctcagggattctggtcttggagcagcccactccaaatgaggggccgtacagaccaaagtcacccctctgaggcagcgtgtggtgatactgatgcagccagagttcttagcaaaagttgatggatggggacaagcagctgctagattaagtaattcctcaaatttgtaaatgtcagcagtggaagaggagcagtctcttacccatctcttgctcaactttctacccccacgcttctcagcacaatgtccttaagcgttattggcgctcccaaaatagttgccaaatgaataagtgacctggggaaggaaaggaaggagggagggaacagaagattgcctgaaaaaggaggagagagttgggtggaaagaatgcattgagctgtgtgccttggttgcaatgcctgtcctgtgaccagaaaatgcatcccaacacatgtcaggctgtgtctagcaggtgggagggagtctggtggagaaatggcattggaccacatactcaccgctaggtctgttcgggatttatttttaattaatttttggtaaactatcaatgattgaatttgaccattgatggccaggtgtggtggctcacacctgtaatcctagcacttggggaggctgaggcaggtggatcccttgaacccaggagttcaagatcagcctggggaatgtggtaaaaccctggctctacaaaaaatacaaaaattacctgggcatggcggtgcatgcctgtagttccagctactcagaaggctgaggtaggaggatctcttgaaccagggaggtcaaggctgcagtgagctgaggtcatgccactgtattccagcctgggtgacaaagtgagaccctgtctcaaaaaaaaaaaagaattagaccattgatcccaggccaatttgctggcttgttggctgtaacaggatgccttctgaggatgggctggttgttcgagcttctggcttctccttcctgggcacatccactcacagctgccacattgtcccaaggaaccttgctttgctgaccaggaaacatgctgtgacaagctgagcggccatctgctatacagctttctgcctctgaggtgttcttagagtgggaagtgttgtagggaggtgtttgggggttcccaagactaccctcaacttcactgattcactggaaggatgcacagaactgttacacgtatggtgatggtttcttacaatgaaaagatgctgattaaaaccatcaaatgaaaaaagtgcatagggcagcgtccaggggaaaccaggcacaagcttccagttgtcctctccccatggagtcatgtggacaacacttctccaagcagtgcgtgacaacacacacagagtattgtcaaccaaggaccctcacttaagcctgggtgtccagagttttttggggagtctgtcacataggcatggctgagtatagtctccaaccccaccagaggtcaagctgataacgtgtagcccaaggccaccatcatatatcacattgttagcatagtctgtctgacctggtctaagcttaggctcacttgagcaaggacactcttatcaggcaggatattccaaaaacaaggaaccaggctagggccacacctctctttggaatgtggagtgtatggacaacccagagctgctgagctagccttttgctcagccccaggttggcctgcacacagacggcgaggggcaccagcactaccgcctttgcccttggtggtttttcctgcaccctaagacccgatttgtctctgaatccaccccatactccagctgccacagtcagagccccgggtttgagcatctgccatgggtgctcacgtatccctgccaaggcttgtgcctgtgcacactcccttgggaagggagagatggaacaaagataaatttcagatttctagattcagctcactgactccagattggcctccgtctacttatgatgaacctcatttatcagaacctgagtttacgagctcagtatgagaaacacagtattgatgcccttccgtcaggaacctggggaggtctcggtcacggaagcccacctgatgttataagatgtgttggctgcgagttgcagttgagatctgttggtcactgctgccctttgaaggccttagtgacatcctgtgggtgttccctgccgagtcctgtgggtagccccgctcactccccacacggttcctctgcccctgcacaagctgcaccctctgcctggtgcccttgccccaccccaactcttcgttgtgatttgtttttaggaaaactaagtccaaatggacaggacccccaactttctgactgcctaacttctcagtctctcctccagcctcaacagggagcctctctgacccccaccttaagctaaacaaagagtctgcagggagaggtgactctgtgtgtgtatgtgtttgtgtgcacgcgtgcagtagctttagtttctgcctcccccacaggactgtaagctcagtgaagcaaggactcatctgcctttcttggattccgagcattgcaatgttgtcaacaaatgaaaagctgagattgaacctcactcatcttgctctctgttagactgtaaacaccatcaggacagagacttgggattgtttcgtggacaaagagagaactcttgttggggttcaagggagtaagaagggcatcacctgtaatgcttagtaatcactgaaacaaggaagcactttgcatgtgcgtcctttacactgagggcacctgcggagctcactcccctagcagccacccaagtccgttcagggacctcattctcccacgggaagttggagaagatgggccgtggctctgcggaggggggtgtggacctgcctcggtacctggagcggttgaggcctgtcttggtggtggctggggcacaggtgtctgcctggcctgtccttacagactgtcagtgttctctttcctggtattttggtgtttgctctgtcaaacccttcttcctcattggttggaactaggtcacaagcacattaagtccggtcatttcctctgccttctgggggtggattttagcagaagaaacaactcctcccttgctggcctcatgacctctggtgaacactagctttcagcaaacagaaacttccagaggccagagcagcactcagtcgcctggccttccagcctcacaggcaagataagccaccctcacagacttctctgtgctcccatctaaacatctaaatcagccatctggtttccttaacagtagcacagactctgggagtttgagagaatgtgtctcttgtgaataagagaaaataagtccatactggggaaggtagctctccaaattgagatgaggaggtcagggtgggagggtgagtggtcgtgggttggccctgatgggaggagctcaccatcagggaagctgaggacctccctcctaatgtgacagcagagtcttggccacctcttcattccccagtccccaacctggctgctctgagtgtctttccagctactggaaagcttcttctgcagcctgcaaagctagctggaactggactgtcagaaaaacatgtagatgctggagaaaatctgttaatcctaacgtatagctctgccttattccagagaagaccgcagtgtggacatgaagatgataaacttgaggtgatggaaggagcagaaatgccagatacattagcagctcttttttcttttgaaaactagcccttgcaagatttgcttgacatactgagtgacactatccagaaaacatcttttttttacttaaaaaaggctgatggtttgttcagacatctcttgtgaactagtgaaaaacataaacgttgaaagctgtaaaattcagcagttctaagtttatttccagcaagagttaaacaaagtttaatagtaaattcaaccaaccagtgttttagctttttgcctatacattatgtttttaaatttcacccattaaacaaggactcaggttacacattgattccttaaggactttaaggaagccacaaccatttatttatagttgcattttgctcttcaggtttccaggatgtttaaaattttttttgactttgtttttaggcatcaagagagaatatatctaaaaaacatttgcatagttagtgtaattgctaagccacagggtgatgggtggatagattcagaggaaggcagctgagggcagaggctgcctgacagagcaggaaaaatgaagctcgagagccttctggctggaaaggcagctcacagatgggccgcagctgtagatcagttctgaactagggactgaagcaagtttgtcgtaaataaaggaaagtggtagtgttgatgttgtgaatgtatatccacaaccagaaccatcagctctggagggaccatcaggctgccactgtggccacagagcatcactcacgtctccattgggcagatttgcagagactcagcagtgaacagagcaagtccctgcctcgtggagctcatatgctgtgagcggtggctcatgcctgtaatcccagcactttgggaggccgaggcgggtggttcgagaccagccgggccaacatggtgaaaccccgtctctaccaaaaatacaaaaaactagccaggcatggtggcaggcgcctggaatcccagctactcaggagactgaggcaggagaatcgcttgaacacaggaggcagaagttgcagtgagctaatatcacgccactgcactccagcctgggtgacagagcaagactccatctcaaaacagaaaaggaggtggagaagaggggtagtggttggaagaaggaattctcctttagggaagatgtctgggaaggcctctctgagagagtggcctttgaaaggagaccctaattggatgagggatgagaggctgagccatgtaagtatctggatggaaaacattacaggcggagacagtggtgtgtgcaaaggccctgggacagggtcacccgtgttaacaggttttaaagctggaattgtggatgggctagagtcagacactaatagggcccagaggggacactggtccttgaaatagaatttgaggatttgaccatggccaggaggctcaggtggcccagtgggaactccttaaatgggaacttcctaaaggaagaatataagaaccaaagtccagggggcagtgccaggcccaacctgtgagggttcccagagttggagggctagagagaatctgcttccagttcaggccatagactctgaacctcacaggcacattgccatccatctcccctcacccccaaccgagacggagtcttgctctgtcgcccaggctggagtacattggcaccatcttggctcactgcaacctctgccttcagggttgaagcaattctcctgcctcagccccccgagtagctgggattacaggtgcccgccacaacacctggctactttttgtatttttagtagagagggggtttcaccatgttggccaggctggtcttgaactcctgacctcatgatctgcccgcctcagcctcccaaaatgctgggattacgggtgtgaatcactgcgccaccctctgccatccatcttaacatggcgccatgagccagcctctcaggaaaagggtctcatgaacaaatgaggaaagcaagtagaggtagggcagggagggagaggcaaaggaatgtgttgttggaaagggtagtgtgcccctcacagatgacagtacccgtctccagatgtgcccactgagagtttatgaaggggctgctccatgtggtccttgactgccctgggggagagtcacagaaagctataatgccactgcctctcggtttccccaggagctcgcccgtcagcgaggagtcctggagcgcacagagaagatggtggacaagatggaccaagatttgaagatcagccagaaacacatcaatagcattaagagcgtgtttggggggctggtcaattacttcaaatccaaaccagtagagaccccacctgaacagaatggcaccctcacctcccagcccaacaacaggtgagtgcatcttctaccatctgggtataaaggagcagaagtggggattagtgcaaatgaccaagactttcagtccacgtcagtgccatgaagggatccaacaaccctttaagttactcatcaggggatatttgtcctcaaacattgtgaaaccaggaactgttcttccctgatcccatgttcacttgattgacatctagtctgtcaatagcttctccaataattgtgaccccactactttgaaagagagggtgttcacctcagcgtaatctgtacaaatgtgactcacttcacataatttttgctttaaaaaatctttagggctgggtgcagtggctcacacctgtaatcccgacacttcaggatgccaaggtgggtagattgcttaagcccaggagctcgagaccagcctgggcaacatagtgggaacccagtctttacaaaaattacccaggcattgtggtgcacacctgtagtcccagctcctcaggaggctgaggtaagaggatctcatgaggcctggagatcaaggctgcagtgagctgtaatggtgcactccaacctgggctacagagggaggccctgtctcaagaaaaaaaaaaaaaaaagtctttatgtctaaatttgtcatatctaatccaattcgcccattgatttttatttgaaaattataaggctgggctcagtggcttatctgtaaaatcccatgctttcagaggctaaggtaggaggattgtttgagaccagcctagacaacatagcaaagacccgtctctataaaaactaaaaaaaaaaaaaaattagccagacatgatggcacgtgcctatattcctagctacaggggagactgaggtggaaggattgctttagcccaggtgttagagactagagttaagctatgatggtgccactgcactacagcatcagtgacagagtctccctgtctctaaaaaaaaaaaaaaaaaaaaaaagatttaaagctaaataattaaaatcaaaaaaataaagttagaagttgctttcctcaggttttggctcgaaatataaaatcatacatgagactgggggccaggcacggtggctcacgcctataatcctagcacttggggaggccgaggcgggtggatcaccaagtcaggaaatcaagaccatcctggctaacatggtgaaaccctgtctctattaaaaatacaaaaaattagctgggcgtgatggcgggcgcccgtagtcccagctactcgggaggctgaggcaggagaatggtgtgaacccgggaggtggagcttgcagtgagctgagatcatgccactgcactgcagcctgggcgacagagcaagactccgtctcaaaaaaaaaaaaattcatgagattttggtagacttcagtgttacatgttcaaggataaaggaatggagtttctgctgaagtagattactattgtttgtatttcagatcactgtgtctgtttttattacaaaaacaacatggccacattacagacaatctatactttacctaccgcaacacaaaaacagaaaatttcattttccccttattcagtattttcatagttgtaaccatagtattcttttggtttgatagcctttttcttccatttaacccagaaaaactgcttgatattatgtgataactcaggttccataaccatctctctctctctcttttatttatttattttttattttatttatttattttttttgagatggagtttcacccttgttgcccaggctggagtgcaaagacgtgatctcagctcactgcaacctctgccttccaggttaaagcgattctcctgcctcagcctcccaagtagctgggatcacaggtgcccacaccatgcctggctaattctttttttttgagacggagtctcactctgtcacccaggctggagtgcagtggtgcgatctcggctcactgcaagctccgcctcccgggttcatgccgttctcctgcctcagcctcccgagtagctgggactacaggcgcctgccaccatgcctggctaattttttgtatttttagtagagacggggtttcaccgtgttagccaggatggtctcgacctcctgacttcgtgatccatccgcctccgccttccaaagtgctgggattacaggcgtgagccaccacatccggcctaatttttgtatttttagtagagatggggtttcaccatgttggccagtctggtctcaaactcctgacctcaggtgatccacctgcctcagcctcctagagtgccgagccaccacgccaggctttttttttttttttttttttttttttgagacagagtctcactctgttgcccaggctggagtgcagtggcaccatctcagctcactgaaacctctgtctcccaggttcaagcaattctcttgcctcagcctcctgagtagctgggattacaggcatgtgtcaccatgcctggttaatttttgtatttttaggagagatggggtttctccatgttggccaggatagtctcgaactcttgatctcagatgatccgcccgcctcagccttccaaagtgctaggattatgggcgtgagccaccacacctggcctctctctttgttttaattctgtaatgtggagcttttctttttcattttatttatttattttttaagagatgaggtcttgctgtgttggccaggttggtcttgaactcctggcctcaagcagtcctcccacctcggcctcccaaagtgctaggattacaggcatgagccaccacacctaactgcagagccgttttttttaatgcatcactaaggtacagtaaaatatgtgcatcttaagtggagagccagtgactgtgaacctgtgtacactagtgtggccaccacccagatcaagatgtagggtgtggcagggaggaaattagataactacttcaaactcagagtggggctggggagaaaccagtgtaggtaacaaagctggtggtgatggcagaaagaacaggcaggcgaagccatcaagagttatggagaggttcaggcatggtggctcatgcctgtaatcccagcaatttgggagactgaggcaggaggatcacttgatcccagcctgagcaacatgacaaaaccccgtctctacagaaaaacacaaaaatgaagttgggcatggtggttcaggcctgtaatcccagcactttgggaggccgaggcgggtgcatcgtttgaggtcaggagtgtgagaccaggccagccaacatggtgaaacccagtgtctcctaaaaatacaaaaatcagccaggcatggtggtgcctgcctgtagccccagctacttgggaggctgaggaggagaatcccttaagcctgggaggcagaggttgtagtgagcggagattgcaccactgcacctcagcctgggtaacagtgagactctgtctcaaaaaaaaaaaaaaaaaaaaaaaaaaaaaggccgggcatggtgagtcacgcctgtaatcccagcactttgggaggccaaggccaacggagcacgaggtcaggagattgagaccatcctggctaacacggtgaaaccccgtctctactaaaaatacaaaatattatccgggtgtggtggcgggcgcctgtggtcccagctactcgggagggtgagaaatgtgtatggcgtgaacccaggaggcggagcttacagtgagctgagatcacgccactgcaacagtgagctgagatcacgccactgcactccagcctgggcgacagagcaagactctgacacacacagacacacacagacacacacacacacacacacacgaaaattagccacacacacacacacacacacacacacacacacacacacacacacacgaaaattagccggacatggtggtacgtgcttgtggtcccagctactgaggtggctgaggtggacccgaccttttggcttaggtgggaggatcacctgaacccagggaggttgagcctacaatgagctatgattgtaccagtctactccagcctgggtgacagagtgagaccctatctcaaaaaaaaaaaaaaaaaaagtactgcaggagggacctgcagagttggccctgggaacctgccggcctcagtgagtgccctggggaggcactagctaaggttatgagggttggttggtttttttggctcagccataatcaccattctgggttctccagctcaaccctaattttaaacatccgccatttccctccagttctagtcgttgcttgttttttgttgtttttttttcaatatacatatcagaaagatgttttatatcctaatctttggccacatttaattgccataggagaaggtaggatgttcatttgttttggtctaagacatcctccatgtacaaactcaggagcagagtgagcccttggaggagtgggaagctggcaagtttgtgactagcaccctttcacacccttccacatcctacatacctcttcacaaaggctgcttctggggctcttggaggcccctgcatccctgaacatagctatgaaagccatggaagtcctgtggctccaggggcagttttctttttttggagcatcatgaaaactcaggggcttcccagcaaaggcttccatcagtgaggcagccatagttatttcagtgaggtgggctttgtctcttgggaagtcctgtttgtccttgctgacagctttccaagctgcttgttctcatttccacttaaagctgatgcgttcccgtcaaggtccccaaagtcatgtaccctgcctggcctgcccctagattagccccaatcagttgtagcattcttgccatctcttagtaaattcaagaaagcaaaactttcacccacactctgcagttctgtgggagcagaagctgcaggaatgcagtctgtctgttggaagatatgggggaggcagacagtccacagggatgcagtggggacccagaggagagggaggttggccctgggaacagaggaaggctgcacaaaggacctgactttttgcagaaggtgaaggttttgagggaacccaccaattgaaggaggggttggtgcaggcacatggcagtaaaagcacaggggaagccgggatgaaggaagttgttggccatttcaagggcccagcagggccagacacagtggctcatgcctgttatcccaacattttataaggccaaggcaggacaatcacttggggccaggagttgaagatcagcctgggcaacatagcaagattctgtctctacaaacataaaaaatttttaaagctgggcatggtgatacaggcctgtagtcatatttacatggacgaccaaaaaaaaaaatgggggggcggctgggtgcagtggctcacgcctgtaatcccagcacttttgggaggctaaggtgggcggatcacgaggtcaggagatcgagaccatcctagctaacacggtgaaaccccgtctctactaaaaatacaaaaaattagccaggggtgatggtgggcacctgtagtcccagctgcttgggaggctgaggcaggagaatggcatgaacccgggaggtggaggttgcagtgagccaagatcaagccactgcagtccagcctgggcgacagagactccatctcaaaaaaaaaaaatgcaataaattgtgagtaaaatttttgtgatcctgtcaaaacctttaatccataaatgcaggaatactgtcacttaaaaactttgccttttttttttttttttttttaagacaatgtctcgctctgtcgcccaggctggagtgcagtggtgcagtctctgctcactgtatcctccacctcccaggatccagcaaccctcccacctctgcctcccaagtagctgggactacatgcatgggccaccatgcactgctaattttcgtattttttgtagaaacaaggtctcactttgtctcccaggctgatctcaaccacctgggctcaactgatcttcccgcctcagcctcccaaagtgctaggattgcaggcatgagccactgtgcctggcccacttaaaagctttttttttttttttttgagatggaatctcgctctgtcacccaggctggagtgcagtggcgtgatctcggctcactgcaagctccgtctcccacgttcacgccattctcctgcctcagcttcccaagcagctgggactacaggcacccgccaccacgcccggctaaattttttttgtatttttagtagagatggggtttcaccatgttagccaggatggtctcgatctcctgacctagtgatctgcccgcctcggcctcaaaagcttttaaaataagtttctcctatcaaacttctgttcagtcatgcatttcctgtgtacatcattatcacacaaacccttcggccttctctgaagttttgtctcttgggaagccctgtttgtccttgctgacagctttccaagctgcttgttctcatttccacttacagctcatgcgttcctgtcacatatgcacccttaatttgaaattctctaacttatttaagacttggtttctgaccaggaaccaccctctcttaaacctctactgtcttatcacttttctcagtctccctagaaattggctttcttggctgagcgtggtggctcacgcctataatcccagcactttggaggttgaggtgggcggatcacaaagtcaggtgttcaagaccagcctagccaacatgatgaaaccctgtctctactaaaaatacaaaaatcaggcctggcacggtggctcacgcctgtaatcccagcactttgggaggccaaggagggtggatcacctgaggtcaggagttcgagaccagcctcaccaacatggagaaaccctgtctctactaaaaatacaaaatgagccaagcaaggtggcacacacctgtaatctcagctacttgggaggctgaggcaggagaatcgcttgaaccagggaggcagaggttgcagtaagccaagatcgcaccattgtaccccagcctgggcaacaagagcagaactccctctaaaaaaaaaaattagccgggcgtagtggcgctcacctataatcccagctactcaggaggctgaagcaggagaatctcttgaaccagggaggtggaggttgcagtgagccgaggtcatgcccctgcactccagcctgggagacagagctagactccgtctcaaaaaaagaaaaagaaaaaaattggctttctttgtgggggagccatttttcacaaagaaaccattgttttcctcatttatgtattaccagtatatatgtgatggcacatagaaagaataaagccagcgttgagatgtgcaggctgaaaggtggccaggcagactcagaagccaagtgtctcttcctactcccagcatggcaatgcactgcccacagtggtgcttagaggagccagttctgtgttctagactttcagtcacagcttccgtggggtgaaatcctggagtgttaaatccttccattcaccaggctctgctgcattctacccatagctggagccctgggcctgcaaaacccttagcttgcgggagtctggacttgctcttgcaagttgggagtcattaaagactttaactgaagaggtgcttgccagtattgctttagaaagatgcgcagcacccatggggagtaaggattggaagggagggaattgaattgagaggcattgccataatccttgttaaaggtaaagaaaagcaaggcaggccgggcacggtggctcaagcctgtaatcccagcactttgggaggccgaggcgggcagatcatgaggtcaggagatcgagaccatcctggctaacacagtgaaaccctgtctctaaaatacaaaatacaaaataaaatacaaaaaccctgtactaaaaatacaaaaaattagccgggcgtggtggcgggcgcctgtagtcccagctacttgggaggctgaggcaggagaatggcgtgaacccaggaggcggagcttgcagtgcgtggagatcacgccactgcactccagcctgggtgacagagcgagactatgtctcaaaaaaaaaaggcaaggcagaaggagaggctgggtttctgggctacttagggggtgggagatcaagagggcgtttgttttgcctggattactgggagtagcgctgtgcagggggagggcaaaaattgcgagtaaccctgattcccagattggctggcgaagtggtcaggctgctgttgagatagaggagagcaggctgttggggaggcacagctcccagctggaggcacctgccataccttagggggctcagcaggatgtcggggatcagcagggcatcaggcatagtctaaatgactttgagttgcaagagctatccctgtctacagccagagtcagcaaactaggccacggagcaaaatcaaagatattttatagggacttacgtgatgagaaaaaaacatactttcacaactttttagtgacaaaatttaaaatataaaaacagtggccgggtgcagtggctcacgcctgtaatcccagcactttgggaggccaaggtgggcggatcacgaggtcaggagatcgagaccattccggctaacacggtgaaaccccgtctccactaaaaatacaaaaaattagccgggcgtggtagtgggcgcctgtagtcccagctactcaggaggctgagacaggagaatggtgtaaacctggtcagcagaggttgcagtgagccgagatcgtgccactgcactccagcctgggcaacagagtgagactccatctcaaaaaaaaaaaaaaaaagtaataggctggacacagtggctcatgcctgcatggctgtaatcctggcacttttggaggctgaggcagggggatcacttgagtaggcacctgtaatcccagctactcaggaggctgaggcagaagaatagcttgaacccgggagatggaggttgcagtaaatcgagatcacgccactgcactccagcctgggcaacagagcaagactctgtctcaaaaagaaaaaacaatttaagaattggccaagcatggtggcttatgcctgtaatcccagaactttgggaggctaaggcgggcggatcacctgaggtcaggagttcgtgaccagcctgcccaacatggtgaaactctgtctctactaaaaatacaaaaaatagccaggtgtggtgggggcctgtaatcccagctactcaggagcctgaggcaggagaatcacttgaacccgggaggcagaggctgcagtgagccaagattgcgccactgcactccagcctaggtgacagagcgagactctgtctgaaaaaatttaaaaaaaaaaaaaaaaaaaaaaaagccaggcagggtggtgagtgcctgtggtctcagttacccaggaggctgaggtgggaggatcacgagcctaggagttagagacttcagtgtttgcaccactatactccaaacttggtgacagagagagaccctatctcaaacaacaacaacaaaaacagtaatagttgagtacagtattctggtaatataagtgcactaatgagaggaatgaaactcttgaggttctaagtttgtcatctgaggtgcacatggtcatctctaaggccattctttgctcatggtcatataaaaacaggtgaaattttgttttgtgtattttaccataataaaaataacttggggccaggcgcagtggctcatgtctgtaatcccaacactttgggaggccgaggtgggtggatcacttgagatcaggagttagagaccagcctggccaacatggtgaaaccccatctctactgaaaatacagaaattagctggggatggtggcacctgcctataactgtaatatcccagctactcgggagactaaggcgggagaatcacttgaacccgagaggcagaggttgcagtgagccaagatcacgccactgcactccagcctgggtgacaaagcaagactccatctcaaaaaaaaaaaaaaagaacggggaaacagtacaaaaacaggaggtgagccagatgtgatcagcaggtcattgtttgctgactgtagtctaaagtaccggtttggttgttccatgtgcttttcatctgcctggtcctaggaatccaggtttccctgagagagggccacctaactcgatgctacactgctttttttttcttttttttcagtaaagacaaggtctcattatgtttcccagatctcacactcgtgggctcaggcaattctcccacctcagtttcccaaaatgctgggattacaggcatgagtcaccacacctggcttagctgccacacttctgaggcaggggtcttcataagcttactgcttggcccactgtgctcctgggagaagctgttgaaatccctactttggtcagaaggagtttggcacagaggaggcatttgatttttagcacacaggcattatgtgaaaagactgataacattgtcataggggtttttcctttttaaacgttttcttttttgtgaacttttatccaaagattgaaagaagctataagtacaagtaaagaacaggaagcaaagtaccaggccagccacccaaaccttagaaagctggatgatacaggtaagtggatacctgtgtgcacagccacatttgaattctggggggagacctctaggtttggcgttggtccttggggggcagtggcaacctctctggggaggtgggcaggggccccagctgctggcatcacccatgctagccaaagggccttagggaccccgcatgctcttgcggagctgggggtgtgcattatggtggggctcctccttctctccctccctccctccatggagaggagaacaaggaagtgagggcctgcattccattgaaaatgagcctgcccggccagcctggtgcagtaacacacgcctgtaatcccagcactttgggaggccaagctgggtgaatcacctgaggtcaggagtttgtgaccagccttactaataacgtggtgaaaccctgtctctactaaatacaaaaaaattagccaaatgtggtggcacatgcctctaatccaagctacttgggaggcttggacaggagaatcacttgtatctgggaggcggaggttgcagtgagctgagatcacgccactgcactatagcctgggcaacaagagtgaaactctgtctcaaaaaagaaaatgagcgtgcccatcattggttcctgcctgtgtcattctcaattgttccagcagtaaaaagccaactgcagaaaaaccccttggtaaatagaatactggcccctcaaagctgtccacgtcctaatccccagaccccgtgagtgtgttaggttatatggcaaaggtggaattacagttgcagatggagttacaattgctaatcagcaagatggggagattatcctgggttgtccagttgggtccagtgtcatcacaaaggtcccttttaagtggaaagagaagcaggagagagagcagcagagtcagagatctgaagatgctgctggccttgaagatagagaaaggggcccacctgccaaggtacacgggtgaactgtagaaactgcaaaaggcgaggaattagattcttcccaagagctccagaaggagtgcaaccctgaggacaccccgactcagcccagtgagacccatgttggacttctgacctccagaaccgtaagacaagtttgtggtcatttgtcacagcatcagtgagggactaatacagcctccagcccaagcagaaggagcagcagccacatggacaaggtgtgcaagacagtgttgatcgaatcattccacttctatcaagtgataggcccagaaacatcccttatctggaaaggaatttagggctcctggggcctcctccataggcccccacaatagccaggtacattgaaattggtgctagaaaccaaaggcttactgtgctgccttcaagaaaacgatacaccatggaagctctggaacccaccatggttgtggttgatgcagctgaggagagcccagatggaggaagagcggggagcaggagagactaacatcatcagcacagttcattctggaaaggcaagtggaggaagtgagtgtaaattgaaaggcaagggctgggaaaaccggcctcatcacaccctggagaaggggcacaggacactgcacccaagacacaattttaaggaattaaagagagtttttatttgtgcagtatatattaacttaaaagactgaagaaaaaatcgacacagtttgcagaatggtttcagttggttggtgctggaggaaatgtgctaagtctagaaagtgaagtttccctgaaagagataaaccgggatgacagggcttttccgtgtgcgtttagaaactgaagttcattcaagccaagaaagataattttaaaaaagaagaaactaaaagttcaaggaagatttcttgtggcaaatgtgcattatttaacatttcttttttttttttttgcgtatttgtttcaagtgcaaagatagtgtagaaataaatttcagaaagaaacgaaattacccataattccatttatgtaacgtaacaatttgtatttttatactttgtccacagactgtgtagttttgcattattgcagttccacttctgtattgtcacttgtgtgactctgtctttcctgagcttgtgcaccaggagttaggtgacccttaatttgagggtgtttgatctcccaagtactgagggaaagtgagaaccctctcctaccccgtggaagcgtctcttcttctggcccatgagcctgcgctgtgctcctccctcatccctctggatagcctcagaaccaaccccttcgttccttccacccattttccagatgaaattgttttgggtgtgtgaagcagcatttgaaggaatgtcaattaaccgctctcctggtgtttccttctaaacttagaccctgtccccagaggggctggttctgccatgagtactgatgcttacccaaagaacccacaccttcgagcctatcaccagaagatcgacagcaacctaggtaagactgagcaccacaccagcttctgtaagccactgtccttcaggcagcttacgccaagcatagcccctgcatgagcatcctccagcttcagttccctcaccacacatcacatcccacgccaagctgggtccatcttgccacctcactgtctctggaatctctccacttctcaccatttcctacttctagcccagccgagccctccccacctctcactttcatgaacagcaccagggacccaggagtccctgagaggccataaagtatagcctggacgtgaccgctcacttcatccttcccacctggccactcagagccctgttttcctccttgtgaaatgggctacctctgagaacagtggaaaggttacctgagccagaaagtgcctgggatggtaagagttagtgctcgtgttgcaattggcactttggccacacagcctccagcatgatgtttcaaaacggaagggtgtgcagggggccgggcgcagtggctcacgcctgcaatcccagcactttgggaggccaaggcgggtggatcacccgaggtcaggagttcaagaccagcctgaccaacatggtgaaaccctgtctctactaaaaatacaaaaattagccgggcgtggtggcaggcgcctgtaatcccagctatcgggtggctgaggcaggagaatcacttgaacccgggaggcagaggttgcagtgagccaagatcgcaccattgcactccaacctgggcaacaagagcgaaactccacctaaaaaaaaaaaaaaagaagaagtgaagggtatattcttccagaactctctcatggaaccccacacactcacagtgcagtccaggctctctttggctgccctagtcccttctgccctcatcacctgcaggctcgtgtgggatttctgatgtgagttctttctgcctcgtggcccctatctgcctggatgggctcccccgactctctgtaggctggctccttctctttctgtcagtcttgcattagtatggcctcctctccctgtctctcaggacccttgtgtttccagggggctgccctggccgtttgtgattgtgtatctgctggtttgcctgctgtcttcccaatcagactgtagattccaggacagcatgggagtgtttccattttgtcactactttgtatctggggcccagcaggcaagcacttagtgattatgttttgttttgttttgttttgttttgagacagagttttgcttttgttgcccaggctgcagtgcaatggtgcaatctcagctcactgcaaccgctgcctcctgggttcaagcgattctcctgcctcggcctcccgagtagctggaattacagacatgcaccaccatgctcagctaattttgtatttttagtagagatgaggtttctccttgttggtcaggctggtctcgaactcccgacctcaggtgacccgcctgtctcggcctcccaaagtgctgggattataggtgtgagccactgcgccctagccagtgattattttttgaatggaaaagtcagttacttgaaattcaagtaggtgttggcctgtgggcagttctgtgagtttattctaagtagtgtctcagacttgctgcctcctcctaccgctactccctgagcagaaatctcccccgtggtgacctgggtcaccctgtcagtctcccaccccctgttaggagttggcaaagtgtaggggacaaataataaaatcctcccctgctgtaaaggtatctagtggaaggcaaaactgaaacccatgaagatgcacatggagtgtctgtgcacgggttttctcctgcttgctgtctgggaagccccagacagctgccacctccttctatgccctggactctgtcctccagagccaaagacttatctgaggcagaaggtgtgtctgcccagatctaaccactccagagaagcccagagaggcgtgaaagccctttgtccttcactgcgagaaagggagaggttagggctagtggtatggttggtgcctgctggcagaagtgggagaagggactttgaggaaggatactgcattcagaggcaggaagaagtgctgagtactgcccgccactaggaggtgctgagggtgcacagttggcactgtggacgagcagctgggcagttaccggcaggacgcagtctagagtaggaggtgggcctgggcagaagggcgagtggctagttcagagctcagccctctggccctgctgacacaggccaggccggtccactctggtggggcagggagtgttgcctttgttcacactcttcccgtcttaacactatctccctgctatttcaggatctcaggcaagctctctggactccagcgccctggcctggtggttttacattatcacacattttatctcagcctctctgtttgcttatcctttgctgccctggctgccagtgagcttcctcctgaggcctgaggcaaccacaggctctgctctccatggagcacgaggccatgaattttagtaagcttaagaagcaaagagctgaagacttatcttttttttttttttaattttaattatactgtttttctctttcttttcttttcttttttagaaatggagtctcgctttgttgcccaggctagtctccaacttctgggctcaagtgatcctcccacctcagcctcccagagtgctgggattacaagcatgagccactgtgcctgacttgaagacaatctttttatttttatattttttaatttctttctgagagttttactctgtcgcccaggctagagtgcagtggcacaatctcagctcactgcagcctctgcctgctgggttcaagtgattctcatgcctcagcctcccgagtagctgggattacaaggtgtgcaccaccatgcccagctaatttttgtatttttagtagagacggggtttcaccatgttagccaggatggtctcgatctcctgacctcaagtgatccacccacctcggcctcccaaagtgctgggattacaggcatgagccaccacactcagcctatctttttatttcattttttgagacggagtcttgctctgtcgcccaggttggagtgcagtgcattgatctcagcttactgcaacctcctcctctcaggttcaagtgattctcttgcctcagcctcccgagtagcagggaatacaggcatgcaccaccacatctggctaatttttatattttttagtagagatggggtttcaccatgttggccaagctggcctcaaaatcccgacctcatacgatccacccacctcagcctctcaaagtgctgggattacaggcatgagccattgtacccggccaaaactacctttttaaaaaaactgattttggccgggcgcggtggctcacgcctgtaatcctagcactttgggaggccaagacgggcggatcacaaggtaaggagttcgagaccagcctggccaatatggtgaaaccctatctctactaaaaatacaaaaaaaattagtcgggtgtggtggcgtgtgcctgtagtcccagctactcaggaggctgaggcagaagaattgcttgaacccaggagacggaggttgcagtgagccgagatcatggcactgcactccagcctggacaaaagagcaaaatgctgtctcaaaaaaaaaaaaaacaaaaaactgattttgcttagatttgtggtaccagtgctaagcctttgtgtatcctgatcctttttctcttagtgttttatatttaatcttgcaagtaagaaggcttacaaagcaccacctcttctctctcctctctggctctttcctggctgctgttcctagtaaaaaggcagaaagcagccctgggcatatctccctacccccagcgtgcacaaacacacacacacatacacacacacacacacagtcacaaacctgggaaaaggctttactcttcaccctgacagaatcaattaagtcaagactcatctctgcagtgggtgcagtccccccaggcaacacagatccctgtctctcccacttacccacaccatcaagaagcatttgcaggtgccgtgactgtttgctcatgcctgcgtgtcatttcctcctcctgcagatgagctgtccatgggactgggtcgtctgaaggacatagccctggggatgcagacagaaattgaggagcaagatgacattcttgaccggctgacaaccaaagtggacaagttagatgtcaacataaaaagcacagaaagaaaagttcgacaactctgaagacagacggatttccactctattgtgatgaaaagatttgaaagatctttttttgaacttccaagaaatttcatttactattttagtatgtaaattaatgtgtgtttgcaaatgttataatagagtaggtcttaagacatttttgctgttataaggaagtgtttgtcccacattttcctagggttaacacctcaccaagttcttccagcaaaatgcttattagagtttttgtctgagcacagtagcctggccctgcatatcttgggcgtttgattaccatgctggaataagaagagttgcatttctcattttaatgagcatatggaaagatgggaacagaatttcagtcttgcagccatgagcctctatttctcattcctaagccttaccatgagtcagagtgttaagggggcctgtgaaccagtcgtttggtggaggagggtccttcccacacctttgtttaggagtcatcattcacacacacacacacacacacacacacacacacacacacacacactctctgagcacattatctgtgattctttcatcctcccagaaaggatcagtgttagaatgggaaatagagtgtgccatcttgctcttttgttggcagatgtccccgcttccctccagccccccatccttggcatgtatattagtaggagggcttcacaccagcactgctcactgcgactcctggaaatgtgtggggaattgggtgagcccctcttccccacgtgctcccatctgtaactctccatctgtgatttgcaacaggtcttccactggctcgaggctgcgaggctgaccgacaggggcgcccaatagagtttgtgggaatggagtattgcacagatgcagctgcacaatggtcttcctccacccctctgggaatcaccattaggcaggcctcagtagggcaaaatgtttatttggtaccgggggtctcctgacctgtctagcattcccacccactcttctgcacttcttgcaaggtaacttgaatcatcacttatttctctgccacctggttttaggactggcactctataaatgacgctgactttgtatagaaggattttgctaagggggcaaaaagcccagataccattttaactggcccagttcattttctcctttcattttacaaaagaaatcatgcagaagcatcaattaaaactgatttatttatgttggtacatccaacaaaatagttggagccacaaggcccttgtctttttaaaaaaacaaaatattttgaagatggtgaaagtgactgattttaataatgagataggtcacttaaaataacagtgcctttgaccttaaaacatggcactggcccatgtgacctttgccatttcccagtacttccctttacagtctgcagcctataaacagtggtgtctcaaagcaaaggaaacctccacaagtgctgcaacagtgcattagtttttatgtagcaatttgtttataaaaattcccatcccataatgcatgaccttcctaaaaatatccacagcctccataggcaaggtgagctttctgtgctacccacttgttagattccagccacctcagggattctgatccatgtcattaacgaccatcccagggtgtgagggcctgattaaagcttatcgaactagacatttgtttattagatgagctcggcattattattttctcaataactggtagaagggaaattttaaacataacactcaacccaaacaaaactacttcgtgaggctttcagcaaaaaggctgcttaaaagcatgaacccgggatgcagagcagcttttgtgcacggttccacttactgtaattgtttctggttctttcctctaacaccttccatgtatgtcaactttttatcaccgtcaggcatagactcgtggagattagtcattatagctcagacctaagctaattatttaaaataaatacatgtaaaggccactgccacattctcagcagacttccacttgcctaatgagattagtgattcaactgacttgaagcacagtaacatcttattttatgcacattccctgtcttttgctggactgatgaagccagtcacccgcccttctctgttttttggttttttttttcttaaccccaggtatatggaaggggagttgccttcacttttctggaaatttgtcttcgtctgacatattagagggcctcgttttgtcctgttcttgttcagaccctctcgttctacgtcctgtgctgaggggactgtccgtaagctacaggacagcgagctggtcctttctgccacttcttccccactcccatgcccaggaaggcctggttgctgatgctactttataaatgagttgcttgcattttcacagagaatgaaggaagacgtaacatggctccagaaacttttcacatgatgattgggatcgacaaaaaaatgctaccctctagactagacacatttcatggagacaagcaaaatggtgccagggctgggctgactgtgggatgggatttggtactgcagacagattttgatttccacagttgagctggaaacaaactgtgccttcaaaaaatgacttttctaacttaaggttggttatatgttaagtgtgctactaacttaaaaaatagtggctgggcgcggtggctcatgcctgtaatcccagtgctttgggaggccaaggcggggggatcacgaggtcaggagatcgagaccatcctggctaacacggtgaaaccccatctctactaaaaacacacaaaaaattagctgggcgtggtggtgggcgcctgtagtcccagctactcaggaggctgaggcaggagaatggcatgaacctgggaggcagagcttgcagtgagccgagacagcgccattgcactccagcctgggcaacagagcaagactccgtctcaaaaaaaaaaaaaaaaaaaaaatagtgcactctctggctggtcacggtggctcacgcctgtaatctcagcactttggaaggccaaggcaggcggatcacgaggtcagaagatcgagaccatcctggctaacacagtgaaaccccgtctctactaaaaatataaaaaattagtcgggcatggtggcgggcgcctgtagtcccaactactcgggagactgaggcagaagaatggcgtgaactcaggaggcggagcttgcagtgagccaaggcgacagagcaagactctgtctcaaaaaataaaaaatagtgcactgtccttcgagaaagttttctaacatctagtaatttgtaacttagaagtggagttgccttgtggatgtcttttttgcattctgtaggaaatgaaacgtgaatttaactcgggttgcaagaaataaaaatgtcagtgcatttaa

SEQ ID NO: 1070 - DNA, 26887 bp, Homo sapiens
ccggcagggggagcgaggaggaagggaaccgcggccgggccaggtgagggagggaggaacacttgccgcgggccgtgctgaggcgctgcgttcgcgtgcggaacccgcgtgtgccgggctagggccatccgacgggcgcgctccctccgggctgcgggagggcacgacgggtggggtggcggcaggtgaagaggagtgtgggcgggtggcggggtggcggggcggcggagcgcggcggggcggtgccctaggcgggagggagggtcggaggagccctatcctgctgcgcgatggaggcggtggaggcggcggctccggctggaggctgggacggcctcgcgcttcgagggcttccgggcccctttagccgagggctcctggagggtcccagcgttgagcaacggggtccgggggtccgaaatcaagcgagtgagtataggcagccggtggggtagggtcggccaacagagccggctgggtggggcccctcacctcttcccgtcgcccttctggttgaccagggtttcctccaccctgacggcctcttctctgctgtggcaagctggccgcccctgcctgcctgcaggtcctgctcaggcacgaaggggttaatgggggctggaagggctctgctcctccctacaaacctcaggcacagaggtctggggacctctggaccgatccttgagcggctgacccagagtctccaggaggccccagggtttttcactttcacttctccctcctcaatgttggcctcacccacaggccccacatctggccagtgccctgaggtgtgtgcagatgtacacaggacacaagcttgggcataccctcaggctggggcacatgcaggagccccacccccatgcccccaccgactggcccaggcctctctgggtgcagactgccaacacaggcacgtctcctgcaacactaccaaatctgcggccaccagcatccctaccacccgcctccacgggactgtccttcctgcaggagcagctcctggggacaatggctggtcctgctcagagaggaaggaaaggggcctggaaccagctggtccatccccacacagcactcctcactggacttgtccctgggtcccctcagtgacactgagagacataagtcattgtcactgtcatggcccagaatgactactcagggcaagaaaaatgcactaaggacagcttcccttttctgacatggcccacaaagctccagctgcaggcggcaggggttgtggggggcaggacatgaggcaccccatacaggcagcaacacacaccacatcccagacaggcagcactattcgtatactcacccactgcggccctggactcacatgcgttcctgaacctcaggcccagggccagcctccccactggcgcccagccccccagcccgttactgggccttcccagttcccagccagcatcctctccagcccagggtctgaggtcctgagatcctaaaaaccctgggagaggttgcctgcctcccactcccatcctgagcatgcacaagcgaaggctgcaatgaggttgtatacagagaggccttgcaaacagtggccctgaccaccagcaccagggaggctccagcaaggcacagaggctccagcaaggcacagaggcacagagctgaggttgacacccagctggagaggccctgtacaggaaagccatgggtgcgctgaactggttagaggagaccctggagacagtaggtggggaaacgcacaggccaagtcaggccttggcgtctgggatgcctgggcctagaaaccaggcagagcggcgggcctcggcctcactctgcccagcctggtcgggccatagagcttctcccggcaggcaggctggctgctgggtgccggggggcagcatacgacccagtggcctgaagttctccaacatgtcctcgtgtcctcggctccctcggctggccaggctccgcccccggccctccctgcgcccggccggtgcgcagggaggtcggaggagcgggcactgcccaccctccggatgtataagcgtcctggccagaggcgggcggtgcgcgcaagtgcgcgtgacgctcgggctcgcgggctgcgcagcctgggcagcgtccctctgctggggtctccagcgacgatagtgagccaacttcagggggctgttgggcatttactgggctgggtcctgtcctgctgcgccaaggaacagaggacgctgcggccctggggctcctgtcagtggccggtgcgagagcccaagctgccctctcctcacccaggtgcaggggcagccagggaggaggtggaggcgggaggggccaagggcaggggcagggctgggctccggcagccactcgctgcttcatgggtgccctgccacctcgggctagggctgggtgctgctggcatagacacctctcctcggggggctgtagaagctgacggtggcttcgctgcacagagaaaggccgtgccttggcaggagcaacgggatgttcaaggggcgttggtcatggaggtccctgggaatggaggaagggggcagggagcttggaaagcaagagggccctgcacttccagggtgctccacccgtctgggcccctcggctgctaccagccccaagtggggggcccatgacgccataatcctctgggccaggggcccctggcagtgagtggcaccacaggcccccgcccccggactccgtgggctgggctgggctgggcgcggtgcggctgggcacacgcagtcggaggcggcgccggccaggccgccgggcgcctatggacgcgcggagcccgctgtctccccgagccagtgcgttcagcatcgcctctctggttgcagcggaggcggcggagcgcaccgcccaccagggctcagggtcctccgaccgggtgaagcttcgctggctgccaggatccccggcagggatgcacttcagcaccgtcaccagggacatggaaggtgagcctccaggccgtgtctacactggcccgcccgccagaccccctgcctcagctgctgtggggcccgggtgcaaagtaggtggaggcagctcttggtagcgtgggctccaggcttctggctgcgattctggggcagagaggaagagccggcatcccgcccacagcctgtcccctcaccagcctgggggcccagcttggagatgggcactcaggtatacacaggcccggaagagggcgagtgaggctgggaaggagagcagaggtggccgtgagcctggagaggggggaggaaagttaataagagaggagagagcgggagagtttcacagaaggagagaaagcctcgaggaagccgtggagacgaaattgagcaaaggggagaaaacacaaaaaacccaaagaagaaggtaggggagaaacagaaggacacgaaaaggcaataaaaagcaagagcgaaagagaagagagaaaacgaagggaaaatttaagacagaaagcgaagtcataaaaaagaaaaaaaggaaagactttagtttttttttttttaaaaagaaaaacataaaaaacaaaggacatacaaaaataagaggaaaggcaccgactaaaagaaagacaaagaatgattaaaaataaagtgaaaaggaaggcgaggatggaggaaaaggggaagaggcggaaagtaaaacagaaataaagagaaactacagagataggggaagaaaaaagatgatcgggagggaaaatttaaatgaggacgacaaaggtaaaataacaaattaggaaaagaacgtctgggagagagagaggagaaacgcacgcgggcgggcggcagagcgagggccggccgacgggcccggcgcaccggtgagccggtccgggcggtcggggggccccgggccgagcgagccgcggcgggcgggctgggggccggggagggggaaggggcgggggaggggcgagggccgggggagggatctagtccattgtctccgcgcgggggtgggggggccccgggcggggcggggcggggcgcctcctcggggccggcctgcggtgtggggctgcacggcccggggcgcacgcagcgcggcgcccgccactcggcccgcggcgcggggcagcgctcagcttggtggcgggggcggcggcggcggcccgcgggtcatgatctccgccgtgtccagcccgtggctcacgcagctctcgcatttctgcgacgttgcagccttcacggccagcagcctgagcagcctgggggccgcggggggcttcccgggcgccgcgtcgcccggcgccgacccgtacggcccgcgcgagcccccgccgccgccgccgcgctacgacccgtgcgccgccgccgcccccggcgccccgggcccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggtcagggcgcccctccccacgccgcgaccctccccacgtgctgccgccagggctgcgggcctccgcctgatccgcgcgagcggggccgaaagccgggtcgggggcgcggcctggccacctgcgggcccctctgggccccgctgcctccttcgctgttcgccgtcccggctccggcgacagccgcccggcgctcccctcctaacacctatcctccgccggggcgggaggagacggcgcgggccgcacgggaacggcgaggagccccgcgggactcgcccgcccgccccgcagccccaggacgccgcgcggcccagaaaccggcccggcttggggcgcacccggctgggggcaggcagcggcgtccagggggcctcaccgcccggccgactcctagtaaatcccacctcaagaaaactctggttcagttctggagttcagtctatgcgggcaagataaagagcggcagccgggcaactctctggacactttcaggagaggattacccttaaaaacagcgtgcactgttgcgtggaagttgctacccagtttccttcaacctagatccctatagttgtggggcctggctctgtatccagcggcccgtcacctcccaaccggcctgtatttgttttaaagaccaagagacaaggggaacaagttttgcagatgcacccgatttgaccggtagacaaaggcgggtgccgcgctgtgtctaatgtacacaccagctcggagtccgaacagccaaggggagctcagggcctgtttgcaaagccttctcgtggtttctgtttccctgctgccggcgtcctttctgaggaacctgggcctgtgctctgctccagctctgtggtttttttccaggccctccttgctgtccccaggcacacaggccctcctgaggacagcggcagcccagccgctggctcaggccagcccggcaagggccttgtcggcgctgggcttcacccgggagcccacgtcccgcagcaccctccagcctgcagaggcttcgggtgggggagggagcgggcctgtcctagaggctggctcctggcatctgtcttctgcccaccgcctgcagggagttgcttgtgaggggaggcagaggggacggcaagtgagggccaatccttgtgttgtcctgaagggccccacggccactactgctgtgccatcatgtgggggtagcccatggcctacacccgtccaggcactgcagaatgtcctttcaagagccctgactggtcactgagccagggtccaaagcgggggagatttgaggaacaggaaagacacaaactgagtacactctgggtagctgcgtcttggggttatgtgtcttaaggggagtggaagcttgccctgtgccctgaggaaggtggggagactcttatcatggggccatgatagagaggggccctgagagtcaggggagggagggctctgagccttggcctcactgaggggattgggtaacagccgaagacccagctaaaagggcagcggggacgccttgaactcacacaggactacccggtttcactttgttggagccgggagctgcttcgatcaagctggggaggctctgctaagggcgcacgttaggcaccctgctgccggccgaagctgggaccaagaggccaaaaagtcagcaagggcgaggccgagtttatgtaggccaaggttgccgaaggtgggggctccagcgctgggctggccatttctgtgtccaggaacggcccaggaggctcccctgctgcgccaagctcccagttgagtaggggcctgcccagattagagcagctaagccaggaaagatggagcccaagggctgggacgacacagcagcccccagaggctggagggaggggccgagcagaggggccgccagccccaggcaggtcaaggggggctgccttccaccagctagggtgacccaaggcctcatcacccccaggcggatgtttcccaccttccaagtgaagctcttcggcatggatcccatggccgactatatgctgctcatggacttcgtgccggtggacgataagcgctaccggtgagcgagtggttgtaagcgtgagggaccgggagggcaccctggaaagtggcgggtctccgcctggtgacccaactccaagggtcgtctgcaccatgaaactctttaggcacctgcgatgctgcccgatcaacccgctccctcctccactcccatctgaccccagacccacaaccctactccatgccctctcagaacccgcctctggagccgcaggctgcagacagctcttgctcccctgggctggtgtggccctagggtggtcagccaagtactcagccccggacttcttcaagtctccctctcccaggaggccggcctgagcgcctagtccccttcccccatccccagggaactctggatcctggagctgggccggaaaggtggggtggccaggagagattatgcagggcgggcctcagctgcccggacaattaacagcaattaataaagagaacgcgcactgccctgtgcctgaggcccggcaaggccaagtgtgggctcccaccgcagcggcaccggggcgggaggacccgcatccagcgaaatgagatggcaggagcccagcctccccctctcggtgccccacagggtgtccagttccttgattgttttgagtgttggggtgggtgggagttctctgtttagtccatagtcccccttggaaaagctcccagcacatgcggcagcagagggttcaatctcacaggtggggaaacttctcaaaggcacttttagggttcgcccagcacacgggtcaaggccctctgggttcacctccacatgcacgaccccaccccgtgccgctccaggtacgccttccacagctcctcctggctggtggcggggaaggccgaccctgccacgccaggccgcgtgcactaccacccggactcgcctgccaagggcgcgcagtggatgaagcaaatcgtgtccttcgacaagctcaagctgaccaacaacctactggacgacaacggccacgtgagcgactgcctccccaggctccggtgtcccccaaggcctcgagtcccgaggcacccgcctgtccctaagaggcctgtagaatccccaggcccccggctgtccccaggcggctctgggctgtccccgaggaggccctttagagtccctgcgaggctagaggctgaggcggagcttgggcagtgctggtgtgccgatgaggagagcggcctctggtcaggggtcgcacagcctagtgggcctgggccctgggagaggggtcgccctccttctctcaccccactcctgattttatgcaggaagcttttttaatggaaaagatggggccctgcaagggggctggagaaagaggctttatggagtccaggccagtgaggtcgctgggcaggcacctaaggaaagagaacctaaacccagatcttttgccacttggagctcattcctggcagttgccaatgggtcacagcctcctcttggcccagtgacccagcctcatcttggaattaagggttttgcccaactcatccaggaaactcattgccaactcagacctcagcccatttcctggctcccaccccagatcctcagcccagccccaccgctggagctgattccccaccttgtcttccagattattctgaattccatgcacagataccagccccgcttccacgtggtctatgtggacccacgcaaagatagcgagaaatatgccgaggagaacttcaaaacctttgtgttcgaggagacacgattcaccgcggtcactgcctaccagaaccatcgggtgagggcctgtggggaggacctgagcggattcaacgcctctggaaaagcgggtgtaattttcagttgccgtttggggacagtgggtccgcttagacctgcaggctgtggtcccagtggagcccaacccaactggagccccactcccaagggcctcaggcagccccctccctctcgaggctggccggcccagcctcctatcagcttgacctctccagcggcaactgtcacttcgtcctgaaagtttgttttccgaaccattccggaaactccccatcaggggcctgatctgaggtttacccagattactagggaacccgctctgttccccaccccccaccccactgcacgtggggggtggtgaccacattcctgtcccagcgaggagcacagggcctccatccccacccacctgggggacaccagagaggggttccctagtgagagaggaggttcctcagacccccgcccccctgcaggagggagcaccagctccgtagaggaggggcagacgtggactggttcttgtcagggcagcagaaaggcccttggtgcgcttctcctaacactcccctatcctccgccgaggtcgggtggcccaggctgcagggctccagcggcttgctcacacccacctccctgcagatcacgcagctcaagattgccagcaatcccttcgcgaaaggcttccgggactgtgaccctgaggactggtgagtgtcctcccccgagagagtgagcgccgggcgcctggcgcaggcgccgccctgatccgcctcccgcccgcaggccccggaaccaccggcccggcgcactgccgctcatgagcgccttcgcgcgctcgcggaaccccgtggcttccccgacgcagcccagcggcacggagaaaggtagggccggggtcgtgggatccgggttccggccctgtgcgcgctctaccccgggccggcggcctcgcccgacctcgcctgcgcccccggggcgctccaggctttcgcgccggttgcacaacggccgcggcggcgggcaagcgcgcactcgcccgcccggcccgacggctgcgccccgcccgccgccgccgccgcccgcagaggggcgcgggccccggggagggctcggggcgccggcgacttggggtctcgggcacgctggcaccgactggtcggggaacaccgagggcggccaagagccttctctccgccagggcctcgcatggggcgtcggagctcctcggcggccccggccggccgcgctcactcctcggccctctccgcagacgcggctgaggcccggcgagaattccagcgcgacgcgggcgggccagcagtgctcggggacccggcgcatcctccgcagctgctggcccgggtgctaagcccctcgctgcccggggccggcggcgccggcggcttagtcccgctgcccggcgcgcccggaggccggcccagtcccccgaaccccgagctgcgcctggaggcgcccggcgcatcggagccgctgcaccaccacccctacaaatatccggccgccgcctacgaccactatctcggggccaagagccggccggcgccctacccgctgcccggcctgcgtggccacggctaccacccgcacgcgcatccgcaccaccaccaccaccccgtgagtccagccgccgcggccgccgccgccgctgccgcagctgccgcggccgccaacatgtactcgtcggccggagccgcgccgcccggctcctacgactattgccccagataacacgggccctgtcgcgctcccgccccggtcctgcacagccccgaagttcgccgggcccggccaccctgccccaagggcaagcaaggaatacgttcccccagccccaggggccaccgcggctctccccttccccagcctcgaagccatgggggccccctcgccacccccagccccttgggctatcgaagtatccggttccccagtccctggagccaccgcgggtccttccccggccccgagggccaagggggtccccgcccgccagtgccaaagcgcccggtcggaggcggaaggaagtgatatttattgttctccccgagaccgcgtcgcccgcggcccggccggcagttgcagtgtagacagcccgagagccccgcctgcaggcggtgtagatacatgtagatactgtagatactgtagataccgccccggcgccgacttgataaacggtttcgcctcttttggaagccgcctgcgtgtccatttatttgtgcccagttagatcgcgttgggaatcttcgggacagcgagcccggggtagctcagggccctcagggcctccccagccccaatccctgccgactgtaggtcggtcccggtcccacagcgccctgtccgccacgcctcctgccctctgcccgccccataggggctcccactgcccctcccctctccgaggcccctcctgccaggcctgtgcactccccccaccttcccaccgtcccgtctcatcccaacctccccagggctggtggtaccgcccaggtgtgcatcctgcctttttacttaaattcctcccacctgcagttgtccctattctgggacttgggcctgcgccctggcctgttttcgggacagatgcttgtgcttttccatggaagctgggaagaagggtcatgacagacactgccggtcggtgctgggagggggagaagcccctgaccgggatggggtcatggaaagacaaaaacaggcagcactgttctgctagcatttcccctgccggcctagcccaggcccgcatgttccctccttagtgactttatttgctgtgagtgtccctacggagtgacctggccagggggcacaatgacagtagccatgagtcatcttgagacctgtgtatgaagcatttttcccaggccaggtggctaagggacctctccccgttaactcaacaccagggatggggcgagaggaactctttgatccctcccttcctgagcgcaagcaggaagggctgacagccggtcagcgccaaggctgctgacttggacacaagatgaacgggaagtgcacgtggccgaggctctgtcccccacctcccgtgcctgtcccagtgtgtttgtggcaactgctgccttctaggccactcggctcatcaccccacgtggtagcggcagcctgagtgccacctctccgagggcacagccaggagtttccagatgtccaccctcgcggacctgtttttcgtatacatgtttgctctggcggcgtgaagtgagtggggtcttagtaattgaatggcaggaaccattcccagaggccagtctagggtgggagggggtctccaggggccatccaaagcctcaaagggcatctagcaccagagagtgaggacctctgcagcatctgcccaggctccgtgagcacggctttggagatgcatttggggggacggctgtggatgcccattcccaagtcctgatccccacctgcgtgaacttggggcagccattacccatgtgccccacggtgggtggggctttgcactgcagagggcctccctctcttgctgtcagaaggcagccattccgtactccacatccaggatgtgcggaggggctgccattcgagacctccgccttggttttgttcagagctaaagggaggaaaagccctcccctgaacaaagagcaaacacagtgtttgtaaatgagggtgggacacacagcaatgtgcaaggaccctgagtgtgcagcaaactggcctgttaccgtgcccctcctgttgggatggccatgcaagatggagcacccagccgtccagcagggccgccgctggccatccggggctgttcgcattctttttttttttttttttttttttttgagactgagtcgcgctctgtcgcccaggccggaatgccgtggtgcgatctcggctcactgcaacctccgcctcctgggttcaagtgatttcttttgcttcagcctcagagtagctgggactacaggaatgtaccaccatgcccggctaatttttgtatttttagtagagacggggtttcaccatgttggccaggctggtctcgaactcctgacctcaggtgacccgcctgccttggtcttccaaaatgctgggctttcaggcatgagccatcacactcggccacacgtcctaatgaactaggattcattaaacattcaggtcctcactggccccattccaggtgctccgtggctcacaggccgcgggtcaccacactgctgctgttgctgctgagggcactcccacgctgggcagtggcccccagaagtgtgggtttcctcccctccacctttgtagatgagtttgtgcatctgagaacttcttgtaaatgagagctcgcaggccggcgtctgggtggcagcttccgctggctgtgtgtctgcaagactggcgcacgccgctgctcaccgtccctcatgtgctcagtcctcaaccagtgcccagtgattgcctgcccgctgcgggggctgtctggctgatgccccagccactaccgttcctgtggaggtgacgttcccatgggcagctgccctaaggcctggcttccagcagcttcctctgtgacagctgtgatctgaacgttcacccccaaggtgatggtggcaggagatggagcctttaggcggtgattaggtcacgagcgtggagtcctcatgagtgggattagttgagtgctatgctgctcacagacctccagcctccagaactgggagaaataactgtccattgttgataagccaccgggcctatggtcatttgtcctagctgcactactggactgacagtggccgttcttccatctccttcttgttccctgttttaggttccccgttgagcacacctgccctgccccttctgtaagctgctgtgatgggcagtatggtgtaggggatagggggctcgtcccaccgctgttcccccacaggctccccctcagctgttggacttcccccaaacatcctcctccaggttccctagctggtccagaggccccgttgccctcccctagcctggctgcagacgtccagctgccaggactcaggaggacgagagaccagaagggcccccagactcctcactcccaaaaactctccaaaaacaacagatgcacaacgcaggaaatagatagattcttgactaagcgggggtggggaccatccacacccccttcacaccactgcatcccacggaagggttctaggaccccagggcctgggggtgcagctggacgatcctgcagtagccccgctccctgttttcagaagacccccccacggctgccctctgcagcatgtgcccctttgtcgaagggacaatgggcactccattgcccagagaggcttctcacccaggaaagcactggaggtgcagaggcaggagcacgcgggggcttggctgcgggacaaggcgagtctgtttggtggcaccttgagctgcggaggaagacaagaccctggcccggtggagatgagaccctggcctggtgggcttcaggccccaccctgcggcgcaccctccagctggggaagtccatggggtgtgtgggatccatgcgatgacagttgtatgaggctgaggccctgatctccaggtgtgccgcagatcaaagcacccgcataccagagaattccacgtagccacagttgccaagggcagaggcagcctcacctctcactggtggagggagagtgatgggtgaggagctgcttctaggacgaaagggatggctccagtgtgtcaggcagtgcaacccaaccaggagctgggcaccaggggagagcatgtggcccgtgttccagagactctgtgttccagagactcagttttcccttcagctgtggtgctgacctccgccctgtgtggagaagctctctgtcaacagtggaggcctgtgtcagccatgggcacggggacgttcattcctgcttctctcctccctgtgggttccaatgaggcggtgtgctcgggcagggtccacaagcatctgcaccatcctgcctctcctccttgccaagctccttcaccccccgccctgaaggagcatcctgcagagcctggccaaggagcaggtgggggcacggccccccagcctggcatagtggcacccaagcctagggagggcaggatgagacctttttccttggtgctacctcacacattttctggatttcaaaaaacacaactggtgcctttgattcaattccctttcctgcttgttgtactacttcaaaccagatgggctcctcagatgaaactccggagactcagtgtctctctttaaccgctgccaggtctgtgtgtgggaaacagcagaaccagaaatattttgctaaaaccagcccatgtgggggagaggcttagcttttaatagcagtaattaaattatcttcttaattataaagggtgatggcattgtcaacatgctttatctatcagctttcaattgcacaaagtaagcacgtaatcctctcctcccggccccactggcatcctctgctctgtggccagcccaggcccccttcctgcagtgcagacccccagaagctttggggtgcatctccccatttcaccagttctgaggtgcacagggttttttgcctgcatttcaacacctctgaagttggtgttctcttattcaaagtggggggtctcagcctaactgaaggatcttggctgcacatgaaaccatggtgcagtggcagttgccagggtgctgcagttgaggcccatgtcggtgcgcccactgtggcctcgggcaacgctgggtgccagcatgttgctctgggtgactttcttgcaggtggtgactccggcttctgtctccagcccttacagtggccctgtccttccaggaccttactcttcattcacatcatttctcaggacactcctccctgcacatccctagtcttccccatctcctcttcattcctctgtcattctagcttcagttcctctcaacagtttttttgtttgttttttgagatagagtcttgctctgtcgcccaggctggagtgcagtggcacaatctcagttcactgcaacttccgcctcctgggttcaagcgattctcctgcctcagcctcccaagtaaccgggattacagatgtccgccaccacgcccggctaatttttgtctttttagtagacatgggtttcaccatgttggcctttttttctttttgagacagggtcttgctctgttgcccaggctggagtgcagtggtgtgatcatggctcactgtagcctcgaactccggggctcaagccatcctccagactcagcctcctgattagctgggactacaggcgtgtgccaccacaccctgctaatattttgtagagacatatgagtcttgctatgttgcccaggctggtcttgaactcctgcctcttgaactcttggcctcaagtgatcctttggcctcagcctcccaaattgctggcattacaagcgtgagccaccgtgcccagccctcttctcaaatagtttttttttcccctccgtttctgaattcatcctttatctcagaatatgttttccggattactcccccaagacaagctttttttcttgtgacatcatcacagaacgaagatggtgacagcagcagggccacaaaacagtccccagtctacccagttgctcatggctgtggtttggaccttcagccatgaggcagtacgtcttcccagggcagggtagggaccttcaccgcggggctgggtctcaggagctgccgggcgcccttctccagcccgcctttgtgataagggacagaatcggggtcactggcaggacacaggtccccttccctgtcgcctcaggctggtgggattcctgcacccgagtgctgctggggctgcaggcgaggcctgggctacacaggaagcccgggcaccgcagagtggccgctagctggtggcattgttcctccacggattcagagcttacgagcacgggcgttgagctgaggcaaaatacggaaacagccacttccatgcaaataatcacccttctgataacaataagtcaagtctcaagggactaagaaaaacaagcagctttattaagatgcagctgaccgatctgaaagcctgcctgctccgccacctcctgggagagcctgcagggcccgagctctggggacaagagctgctgctcaggccccagaggaaggtctaggtgggaaatgggccgccaggaggtggacaccaacacataggagcacatcccaagacacccatcaccctgtgtggtgggtgctggaaagaaacagcctagttatgagagagacttgcaactgggggcaccctagcaccccacggaggcatttccaggtggcccctccagcttggctgtgtgggcttccttggaggaccctccctccaggcggccagccagaaggggccatctccaggcaggcacccccttcaggagagcccatgcccagtcactgcctgggaagcttactgcagggctggcccccacctgccactgtcacctcctgacctccacctgctctcctgggtcctcaggcctcacacagtcctgtccttctaacaggtgactgcaggatggagccccaggcatctcggcatcctgatgcggtcactgccaggaggggagtggtctcagggtgggccagacccctggacaccagcgtggtctccttcctgagctgccgagggagatttgcctggcaaagcccacctggcccctcggccctcagccgccgagtttccctcctgcagtgggaggtttcccacgactggagggaagcagtggctattccagtagtagctgtttctcatgcacaggtctcttccccagaaagaatttgagctgcaggacagagatcctatcacatatatacccagaaggtgattcaaggtgaatattaaagacttggatatccattaggatgatgatgattttaaaaaacaaaaacagaaaacaacacgtgttggtgaggacatggagcccctggaagccgtctacactgctggtgggactgtaagatagtgcagcttctgtggggaacagtgtcatgggtccttgaaaaattatacagttgttagggagagtgaagcaggaggactgcttgaagccaggagttcaagacccgcctgggcgggcctaggcacctgtagtcccagctactcaggaggctgaggcaggaggatcgcttgagcccaggagttccaggctgcagtgagctacgatcacaccactccacgccagcctgagtgacagagcaatatcttgtctctaaaatcaattaaaattctacatagaaccgtatgttccaggaattccacttctgggaaaatacccaagagaattgaaagcagagtctcaaagagatatttctccacccatgttcatagcagcattactcaaatagcaaaaggtggaggcgagccgagcgtccaccgataagtgaacggatcaacaaaatgtggtgtgtgtgtaccgtggagtattatccagccttaaagaggaagggaattctgttacatgctacaacagggatgaaccctgaggtccttatgctccgtgaattgagccggtcacaaaggacacattttgtactgtacaattccacttgcatgaggcacctcaagtagtcagattcaagaaacagacaggagaatggggattgttagggactgggggagaggaatggggagttggcgtctagtggggacagaggttccattttgcgttcatctggaggtggacgcacagcatcgggaatacacaatgccactgaattgtgtacttcaacatggtcacaatggcacattctttattttttgtagagacagggtgtcactgtgttgcccaggctagcctcgaactcgggttcaggctctccttccacctcggcctcccaaagtgctgggattataggtgtgagccaccacacctggccaaatttgtgggttttttggtttttatgtttttgaaacagagtttctcccttgtcacctaggctggagtacagtggcgcgatcttggctcactgcaacctttacctcctgggttcaagcgattctcctgcctcagcctcccaagtagctgggattacaggcacctgccaacacacccagctaattttttctatttttagtagagacggggtttcaccatgttggccaggctggtctcgaactcctgacctcaggtgatccgcccacctcagcctcccaaagtgctgggattacaggagtgaggcgctgcgcccagccaaaatttgtgtttttaaatgtatgtttaacaatttaaaaatcctagatcatccacagtttgcaaaagccactgctatccatcttggattgaccaattccctacctgcctctaaagcggtggttttttaacaggagcagtcttgccccctggggtgtttgacagtgcctgggacactgggtgggggtgcttctggcatctggtgggtggaggtggggtatgcttttcacctcctgcaatgcacgctcggaaccacaggtccggagccatggggctgctgtggcgaggtcttcccacatggccgcaccctgtctgaaggagctagtggtggggccccgaatattctgaggccaggagctcccaagtcccacctggcatgaagcggtgccccagggccctctccgcactcctccccctgcccaagtgggcccagactccccagtgaggccgcatggcctggagtgctcgcctggagcctgaggggtctggctgctgtgaggtgggcttcgagggtggctgccaggctgtgctggagagggctgggcatcagaaggctggtgacagccttgcagggagacggagggttaccggagccatccctggaggtggcccctccaagtgctcgggccccaggcaagtcccaccggctcccgagtggaaggtgtaagccacgtgggcacaggtgggagggagttctcaccacccatggctgctagtgcccctgaaaccacctggaagtcccagcggcttccccagggacaggcagtgctgtggcccgtgtccaccccagctctggggcctgtgctcgtggctccgtgtctgcccgtggtctccctctctctcaggggtggtttctctgtccctacccaatatggtgctctatagctttccttaggatcctagctcctcaggaggaagacgtgtggccccttgctccaggaaggcccagtcctccctcactgggggtgggagggtaaggcaaaagtgccaaagtgtccatcccatgaatgcaagacacacagtgcctgctctagaagagctcatgttccagcagggacagctaacacccaggggcctgcacggggtggagggctcttcagaggcaggatcacctcggagatgggtgcaggggacctcgggccaccccagggccaggcctgcttgccctgcttaggagctgggtctcccactcagggagggaggggtcatgtctcaagggcagccactgggcctgaaaagcagaaccgcatgtgatcagtctgggtgggcaagacttcaagagagcacgcctaccctcaagggatggaagcagaggctggtagccgacgtccatgccagccaccaactcagagccagcacactacccgcatgtgcctctgccaatgagtggatgaaaagcagcgacctacagatgcaggcaacctggatgagtcttgactttatctcacggagggaaggaagcaggctcgggaggtgccgtgccgcgtggctctgtttataagctgtctgggaaaaggcaaaaccacagtacagaacacagatcagccagtgcaggcaggaagggccagcacacggggtgggaggagcttcctgggtaacgctcaatcccatacgctacagagggcgcatgttattgaacattaaggtttttttaaaaaattttaatttaatataatttaattattattatactgttttagggtacatgtgcacaacatgcaggtttgttacatatgtatacatgtgccatgttggtgtgctgcacctattaactcgtcatttagcattaggtatgtctcctaatgctatccctccccctccccctaccccacaacagtccccggagtgtgatgttccccttcctgtgtccgtgtgttctcattgttcaattcccacctatgagtgagaacatgcggtgtttggttttttgtccttgcgatagtttgctgagaatgatggtttccagtttcatccatgtccctatgaaggacatgagctcttcattttttatggctgcatagtattccatggtgtatatgtgccacattttcttaatccagtctatcgttgttggacatttgggttggttccaagtctttgctattgtgaatagtgctgcaataaacatacgtgtgcatgtgtctttatagcagcatgatttataatcctttgggtatatacccagtaatggggtggctgagttctactcttataaagagcgtgctggcctttcccatgccttctcgtctgttttgacccattctgggtatcggtccttttcgtctccccctctccatcctctctcagcccctttcactgggtttcagtgtgctgggcacaggttcagggtgtgttgttactcttaatttttttttttttttttttgagacagggtctccctctgccccccagcctggagtgcagtggtatgatcatggctcacggcagccttgacctcctaggctcaagtgatcctcttacctcaacctcccatgtagctgggaacacaggcacgcaccaccatgcccggctaatttttaagttttttgtggagatgggattttgccatgttgctcaggctggtctcgaactcctgagctcaagtgatcctcttgccttggcctctcaaagtgctgggattacaggcgtgagccaccacacccaaccaggatttattactcttaactagtaaaacagcacattcctgctcatttcaagagacaggatcttgctctgtcacccaggctggagtgcagtggcatcgtgatcaaggctcactgcagcctcaacctcccagtctcaagcaaaccttcctcctcagtctcccgaacagctaggactacaggtgtgtgccaccacacctggcttttttgatgttgttgttgttgttagagatgggggtctcactatgttgcccaggctggtcacaaactcctgagctcaagtgatcctcccgcttttgccctccaaagcactgggattataggtgtgagccactgcacctggccattgctccttatttcttttctttctttcttttcttcttcttttttttttttgagacggagtttcgttctggttgcccaggctggagtgcaatggcgtagtctcagctcactgcaaactccacctcctgggctcaagcaatcctcctgcctcagcctcccaaatagctgggattacaggcatgcgccaccatgcctggctaatttttgtattttcagtagagacggggcttcaccatgttgggcaggctgatctcaaactcctgggctcaaatgatccgcctgcctcagcctcccaaagttctgggattgtaggcatgagccaccgtgtccagcccctttgaaaccccatctctactaaaaatataaaagttagctggacgtggcggcaggtgcctgtaatcccagctacttgggaggctgaggcaggataactgcttgaacttgggaggtggaggttgcagtgagctgagattgcaccactgcactccagcctaggcaacaataagactccgtctcaaacaaataaaataaataaaagtaggtaagggggagatctggttccctgatccgacgtctttccttggggtcactgactgtgggaaaggcctgtgctgggctgaggtgggacctggtgtggctgtggaggccgtgtctgtgtctgtgtcctgtgggcggctcggctcgttgggagatgcagtcctgtcctgcccttccatgcggttcagacactggacatttgtgcagtctgatctgcaagaaaagagaggcacctctgacatggtacttcatccactctcattggatggggttgtcacccaggtggacatgtcctgaaggacaaggaagtgaaagctgagacgtctaggaacacaccagagagagaagtggagcttctgagggatgcaggtggctgtgtgaacctggggctcccctgccccgcagagtgccaacccttcaatacccagggcctggtggctgggaggaccgcaggtgaccgtctttgttgaatgctgaggccgggccatgggcacatggagttgtcgtgtttcccttcactttggttcatgtttgaaatttccaaaattaaaaaaacagtgacttgttcagtaaattccaatatgaataaagtgcatgttttgtaataaatacttctccatagagtcacactcccagttgataaatcaaaacttgttggataaaacaaagtaaatttctcctgacatttaaacattgactgtaaactcattataaacacttctaaatatttaatggaaactacaagcttaacatatctgatccaaaaatgccttaaacacctcagtacagacacccacacactatgaggatgattccctcaaactggttctgaaagcagtagctgtgcttttctctatcgcgttcttattctttctccgacgtgctcttagcaccctcctggggattagcatccgacccacatcactcgggaaaagccctggctggcggctcccaggcggaggcaccacggtgaggccaagtgctgctgtccagtaagcctgactgccccctcaggctctttcccttcacatttacttatttattttttaaatcgacatataaaattgacgtatttattgtgtaaacttcttaccacaaaaatgagaactatgtcaggtgatgtatttgctagttagctagacttaagcaggcctttagttttcagtttttaacattgagggaaaatacacgtaaatcaaatttaccatcgtagccctttgtaagtgtacatttcagtggcatgaagtccatccacatgactgtgcagccatcaccaccagccatctcagaactcttcatctcagaaaactgaaactctgtccccattaaacaagaactcctcattcccctcccctggcagccagcattctactctctgtctctgtgaatctgactactctaggcgcctcatgtaagtggaatcacacagcatttgtctttttgtggctggcttagttcactgagtgtaaggacctcaaggttcatccgtgttctagcctgtgtcggaactccctgcctttataaggctgaacactattctgttgtatgtctgtaccacgttttgttgattcattcttctgtcaatggacacttgggttgctcccacctgttggctgctgtgagtaatgccgctatgaacgtgggtatagaaatatctttgcagccctgctttcagttctcttgggtattctgccacaagaggaactgctggctcatatggtaattctatgtccaggattttgagaaatgaccacactgttttccatagctgctactccatttttacattcccaccaatagcgcacaagggttcagatttctccacacacttgttttctgtttttttttttgttttttttttttgagatggagtctcgctccgtcgcccaggctggagtgcagtggcgcgatctcggctcactgcaagctctgcctcctgggttcatgccattctcctgcctcagcctcccgagtagctaggactacaggtgcccgccaccacgcccagctaattttttgtagttttagtagagacggggttttaccatgttagccaggatggtctcgatctcctgacctcgtgatccacccgcctcagcctcccaaagtgctgggattacaggcgtgagccactgcacccggccctgttttgtttttatttttggtgtacccatcctcatgggtgtaaggcagtatctgtctcattatagttctgacttgcatttccccagaggatagtgatgctgtgcctgctggctactcatacatcttctttggagatatgtctacttaagtcatttgtctatttttttttaatttttaatttttagagacagggtctcactatgttgcccaggctggactccagctcctggattaagtgatcctcttgcctcagcctcttgaataactgggtacataccacggcacccaggatggcccatttttgaatcggcttttttgttgttgttgagttttaggagttctctatatattgtggatattaatcccttatcagatatatggtttgtaaagattttctctcagtctgtgggctgcttttttactctgttgatggtgtcttttgatgcatacaacttttaaattttcatgaagtccagtttgtctatttttttcttttgtgaaatgtgcctttcgtgtcatatccaagaatttattgctaaattcaatgtcatgaagcttttggcctatgttttcttctaagggttttatggttttaggtcttaatttaggtctttgctctattttgagtttatagggtatgaggtgggggatcaaactgcattcttttgcatttgtaaatccagttttcccaacatcatttgttaaaaagacagtcttttcccccattgaatggtcaccacattaaaaatcatttggccagccaggtgcagtggcatgtacctatagtcccagctacttgggaggcagaggtaggagaattgcttgaggccaggagttcaagaccagactgggcaacgcagtgagaccctgtttctaattgagaaaaatatcactggtttatttctaggctgtctattctattacattggtctttacatctgcctttatgccagtaccacactgttttgattactatagctttatagtaaattttgaaaccaggaagtatgaatcctccaagtttattcattttaagattgttttagctattaaggggtccttgagactccatatgaatttcaaaatggctttttctatttctacaaaaaatgtcattgggatttttgaagggaatgcattgaatctgtagactgctttgggtagtatggatatcttaacaatgttaagttttccaatccatgaacatgggatgtatttccatttatttatgttttaatttctttcagcagtgttttatagatttcagtgtacaagtctttcacctccctagttaagctaattcttaagtattttattatttttaatgctgagtctcttttgataacaaaacctcttgttatgttgaggaactctttagcccatcttttgtatttgctttcagtttgtgacactttagcatctcttcctgagatgagcgattctttgggtttcatggatgggagagcccattgcattatcctttcatttggagatattgcctggtgtgttgggacaaggaaggactaaccttccttgtcagtgtcttatcacacccgcagggctgagtgacagggtggtcctgggcaggctgcctgtggctgtgcaagctgagtgggtgcacactggactcttcccacctactgatggtgtgtgaggctgatgtgcatggattctagctccttccctgtttctggggcctcagctgtctgtgttcactctttcttgctacacaaagagaaacaaggacaagccttatttgataaaggccacaaacactttgaccttcctccacccagtgtagggatctgtttcccctctcctggactccagggctggtcacagaaggctctgggctccaacctggcttgctggacgtgctcttgaagcccccaagtaagaagtctgagtccctgagaccaccacactgcaaggacacttgaaggtactcaggttggtggtccccgctgtgcccagcccctgaatgaagccaaggctccaagcacctgagtgaagaggctgtgatggaagcgaatcctccagccctggccatcaccccgtggagtagacaaactgctcagcccagcctctcctaaattcccgacccacggagcccacgtgcccagaatggctgttatgctgctctgtttgaggtggtttattaatgtagcaagagataatggcaccaggatgaggccaaatgactcgatttctctacaccccacattttacaggtttcagagcccaagtcaggaggtcaagtgtgcatgcaagaggtggcaggggacagatgtgctgctgttcccaggccacctgcacagctggatggtggaagcagttcacttaaaggccatgagttactcgggaggctgaggcaggaggatcacttgagcctattagttggaggctgcagtaagctatgatcatgccactgcactccagcctgggtgacagagtgagacccccactgtccctggtctcttaaaagaaaaaacaaacaaacaaaccaa

SEQ ID NO: 1071 - DNA, 22843 bp, Homo sapiens
ccggcagggggagcgaggaggaagggaaccgcggccgggccaggtgagggagggaggaacacttgccgcgggccgtgctgaggcgctgcgttcgcgtgcggaacccgcgtgtgccgggctagggccatccgacgggcgcgctccctccgggctgcgggagggcacgacgggtggggtggcggcaggtgaagaggagtgtgggcgggtggcggggtggcggggcggcggagcgcggcggggcggtgccctaggcgggagggagggtcggaggagccctatcctgctgcgcgatggaggcggtggaggcggcggctccggctggaggctgggacggcctcgcgcttcgagggcttccgggcccctttagccgagggctcctggagggtcccagcgttgagcaacggggtccgggggtccgaaatcaagcgagtgagtataggcagccggtggggtagggtcggccaacagagccggctgggtggggcccctcacctcttcccgtcgcccttctggttgaccagggtttcctccaccctgacggcctcttctctgctgtggcaagctggccgcccctgcctgcctgcaggtcctgctcaggcacgaaggggttaatgggggctggaagggctctgctcctccctacaaacctcaggcacagaggtctggggacctctggaccgatccttgagcggctgacccagagtctccaggaggccccagggtttttcactttcacttctccctcctcaatgttggcctcacccacaggccccacatctggccagtgccctgaggtgtgtgcagatgtacacaggacacaagcttgggcataccctcaggctggggcacatgcaggagccccacccccatgcccccaccgactggcccaggcctctctgggtgcagactgccaacacaggcacgtctcctgcaacactaccaaatctgcggccaccagcatccctaccacccgcctccacgggactgtccttcctgcaggagcagctcctggggacaatggctggtcctgctcagagaggaaggaaaggggcctggaaccagctggtccatccccacacagcactcctcactggacttgtccctgggtcccctcagtgacactgagagacataagtcattgtcactgtcatggcccagaatgactactcagggcaagaaaaatgcactaaggacagcttcccttttctgacatggcccacaaagctccagctgcaggcggcaggggttgtggggggcaggacatgaggcaccccatacaggcagcaacacacaccacatcccagacaggcagcactattcgtatactcacccactgcggccctggactcacatgcgttcctgaacctcaggcccagggccagcctccccactggcgcccagccccccagcccgttactgggccttcccagttcccagccagcatcctctccagcccagggtctgaggtcctgagatcctaaaaaccctgggagaggttgcctgcctcccactcccatcctgagcatgcacaagcgaaggctgcaatgaggttgtatacagagaggccttgcaaacagtggccctgaccaccagcaccagggaggctccagcaaggcacagaggctccagcaaggcacagaggcacagagctgaggttgacacccagctggagaggccctgtacaggaaagccatgggtgcgctgaactggttagaggagaccctggagacagtaggtggggaaacgcacaggccaagtcaggccttggcgtctgggatgcctgggcctagaaaccaggcagagcggcgggcctcggcctcactctgcccagcctggtcgggccatagagcttctcccggcaggcaggctggctgctgggtgccggggggcagcatacgacccagtggcctgaagttctccaacatgtcctcgtgtcctcggctccctcggctggccaggctccgcccccggccctccctgcgcccggccggtgcgcagggaggtcggaggagcgggcactgcccaccctccggatgtataagcgtcctggccagaggcgggcggtgcgcgcaagtgcgcgtgacgctcgggctcgcgggctgcgcagcctgggcagcgtccctctgctggggtctccagcgacgatagtgagccaacttcagggggctgttgggcatttactgggctgggtcctgtcctgctgcgccaaggaacagaggacgctgcggccctggggctcctgtcagtggccggtgcgagagcccaagctgccctctcctcacccaggtgcaggggcagccagggaggaggtggaggcgggaggggccaagggcaggggcagggctgggctccggcagccactcgctgcttcatgggtgccctgccacctcgggctagggctgggtgctgctggcatagacacctctcctcggggggctgtagaagctgacggtggcttcgctgcacagagaaaggccgtgccttggcaggagcaacgggatgttcaaggggcgttggtcatggaggtccctgggaatggaggaagggggcagggagcttggaaagcaagagggccctgcacttccagggtgctccacccgtctgggcccctcggctgctaccagccccaagtggggggcccatgacgccataatcctctgggccaggggcccctggcagtgagtggcaccacaggcccccgcccccggactccgtgggctgggctgggctgggcgcggtgcggctgggcacacgcagtcggaggcggcgccggccaggccgccgggcgcctatggacgcgcggagcccgctgtctccccgagccagtgcgttcagcatcgcctctctggttgcagcggaggcggcggagcgcaccgcccaccagggctcagggtcctccgaccgggtgaagcttcgctggctgccaggatccccggcagggatgcacttcagcaccgtcaccagggacatggaaggtgagcctccaggccgtgtctacactggcccgcccgccagaccccctgcctcagctgctgtggggcccgggtgcaaagtaggtggaggcagctcttggtagcgtgggctccaggcttctggctgcgattctggggcagagaggaagagccggcatcccgcccacagcctgtcccctcaccagcctgggggcccagcttggagatgggcactcaggtatacacaggcccggaagagggcgagtgaggctgggaaggagagcagaggtggccgtgagcctggagaggggggaggaaagttaataagagaggagagagcgggagagtttcacagaaggagagaaagcctcgaggaagccgtggagacgaaattgagcaaaggggagaaaacacaaaaaacccaaagaagaaggtaggggagaaacagaaggacacgaaaaggcaataaaaagcaagagcgaaagagaagagagaaaacgaagggaaaatttaagacagaaagcgaagtcataaaaaagaaaaaaaggaaagactttagtttttttttttttaaaaagaaaaacataaaaaacaaaggacatacaaaaataagaggaaaggcaccgactaaaagaaagacaaagaatgattaaaaataaagtgaaaaggaaggcgaggatggaggaaaaggggaagaggcggaaagtaaaacagaaataaagagaaactacagagataggggaagaaaaaagatgatcgggagggaaaatttaaatgaggacgacaaaggtaaaataacaaattaggaaaagaacgtctgggagagagagaggagaaacgcacgcgggcgggcggcagagcgagggccggccgacgggcccggcgcaccggtgagccggtccgggcggtcggggggccccgggccgagcgagccgcggcgggcgggctgggggccggggagggggaaggggcgggggaggggcgagggccgggggagggatctagtccattgtctccgcgcgggggtgggggggccccgggcggggcggggcggggcgcctcctcggggccggcctgcggtgtggggctgcacggcccggggcgcacgcagcgcggcgcccgccactcggcccgcggcgcggggcagcgctcagcttggtggcgggggcggcggcggcggcccgcgggtcatgatctccgccgtgtccagcccgtggctcacgcagctctcgcatttctgcgacgttgcagccttcacggccagcagcctgagcagcctgggggccgcggggggcttcccgggcgccgcgtcgcccggcgccgacccgtacggcccgcgcgagcccccgccgccgccgccgcgctacgacccgtgcgccgccgccgcccccggcgccccgggcccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggtcagggcgcccctccccacgccgcgaccctccccacgtgctgccgccagggctgcgggcctccgcctgatccgcgcgagcggggccgaaagccgggtcgggggcgcggcctggccacctgcgggcccctctgggccccgctgcctccttcgctgttcgccgtcccggctccggcgacagccgcccggcgctcccctcctaacacctatcctccgccggggcgggaggagacggcgcgggccgcacgggaacggcgaggagccccgcgggactcgcccgcccgccccgcagccccaggacgccgcgcggcccagaaaccggcccggcttggggcgcacccggctgggggcaggcagcggcgtccagggggcctcaccgcccggccgactcctagtaaatcccacctcaagaaaactctggttcagttctggagttcagtctatgcgggcaagataaagagcggcagccgggcaactctctggacactttcaggagaggattacccttaaaaacagcgtgcactgttgcgtggaagttgctacccagtttccttcaacctagatccctatagttgtggggcctggctctgtatccagcggcccgtcacctcccaaccggcctgtatttgttttaaagaccaagagacaaggggaacaagttttgcagatgcacccgatttgaccggtagacaaaggcgggtgccgcgctgtgtctaatgtacacaccagctcggagtccgaacagccaaggggagctcagggcctgtttgcaaagccttctcgtggtttctgtttccctgctgccggcgtcctttctgaggaacctgggcctgtgctctgctccagctctgtggtttttttccaggccctccttgctgtccccaggcacacaggccctcctgaggacagcggcagcccagccgctggctcaggccagcccggcaagggccttgtcggcgctgggcttcacccgggagcccacgtcccgcagcaccctccagcctgcagaggcttcgggtgggggagggagcgggcctgtcctagaggctggctcctggcatctgtcttctgcccaccgcctgcagggagttgcttgtgaggggaggcagaggggacggcaagtgagggccaatccttgtgttgtcctgaagggccccacggccactactgctgtgccatcatgtgggggtagcccatggcctacacccgtccaggcactgcagaatgtcctttcaagagccctgactggtcactgagccagggtccaaagcgggggagatttgaggaacaggaaagacacaaactgagtacactctgggtagctgcgtcttggggttatgtgtcttaaggggagtggaagcttgccctgtgccctgaggaaggtggggagactcttatcatggggccatgatagagaggggccctgagagtcaggggagggagggctctgagccttggcctcactgaggggattgggtaacagccgaagacccagctaaaagggcagcggggacgccttgaactcacacaggactacccggtttcactttgttggagccgggagctgcttcgatcaagctggggaggctctgctaagggcgcacgttaggcaccctgctgccggccgaagctgggaccaagaggccaaaaagtcagcaagggcgaggccgagtttatgtaggccaaggttgccgaaggtgggggctccagcgctgggctggccatttctgtgtccaggaacggcccaggaggctcccctgctgcgccaagctcccagttgagtaggggcctgcccagattagagcagctaagccaggaaagatggagcccaagggctgggacgacacagcagcccccagaggctggagggaggggccgagcagaggggccgccagccccaggcaggtcaaggggggctgccttccaccagctagggtgacccaaggcctcatcacccccaggcggatgtttcccaccttccaagtgaagctcttcggcatggatcccatggccgactatatgctgctcatggacttcgtgccggtggacgataagcgctaccggtgagcgagtggttgtaagcgtgagggaccgggagggcaccctggaaagtggcgggtctccgcctggtgacccaactccaagggtcgtctgcaccatgaaactctttaggcacctgcgatgctgcccgatcaacccgctccctcctccactcccatctgaccccagacccacaaccctactccatgccctctcagaacccgcctctggagccgcaggctgcagacagctcttgctcccctgggctggtgtggccctagggtggtcagccaagtactcagccccggacttcttcaagtctccctctcccaggaggccggcctgagcgcctagtccccttcccccatccccagggaactctggatcctggagctgggccggaaaggtggggtggccaggagagattatgcagggcgggcctcagctgcccggacaattaacagcaattaataaagagaacgcgcactgccctgtgcctgaggcccggcaaggccaagtgtgggctcccaccgcagcggcaccggggcgggaggacccgcatccagcgaaatgagatggcaggagcccagcctccccctctcggtgccccacagggtgtccagttccttgattgttttgagtgttggggtgggtgggagttctctgtttagtccatagtcccccttggaaaagctcccagcacatgcggcagcagagggttcaatctcacaggtggggaaacttctcaaaggcacttttagggttcgcccagcacacgggtcaaggccctctgggttcacctccacatgcacgaccccaccccgtgccgctccaggtacgccttccacagctcctcctggctggtggcggggaaggccgaccctgccacgccaggccgcgtgcactaccacccggactcgcctgccaagggcgcgcagtggatgaagcaaatcgtgtccttcgacaagctcaagctgaccaacaacctactggacgacaacggccacgtgagcgactgcctccccaggctccggtgtcccccaaggcctcgagtcccgaggcacccgcctgtccctaagaggcctgtagaatccccaggcccccggctgtccccaggcggctctgggctgtccccgaggaggccctttagagtccctgcgaggctagaggctgaggcggagcttgggcagtgctggtgtgccgatgaggagagcggcctctggtcaggggtcgcacagcctagtgggcctgggccctgggagaggggtcgccctccttctctcaccccactcctgattttatgcaggaagcttttttaatggaaaagatggggccctgcaagggggctggagaaagaggctttatggagtccaggccagtgaggtcgctgggcaggcacctaaggaaagagaacctaaacccagatcttttgccacttggagctcattcctggcagttgccaatgggtcacagcctcctcttggcccagtgacccagcctcatcttggaattaagggttttgcccaactcatccaggaaactcattgccaactcagacctcagcccatttcctggctcccaccccagatcctcagcccagccccaccgctggagctgattccccaccttgtcttccagattattctgaattccatgcacagataccagccccgcttccacgtggtctatgtggacccacgcaaagatagcgagaaatatgccgaggagaacttcaaaacctttgtgttcgaggagacacgattcaccgcggtcactgcctaccagaaccatcgggtgagggcctgtggggaggacctgagcggattcaacgcctctggaaaagcgggtgtaattttcagttgccgtttggggacagtgggtccgcttagacctgcaggctgtggtcccagtggagcccaacccaactggagccccactcccaagggcctcaggcagccccctccctctcgaggctggccggcccagcctcctatcagcttgacctctccagcggcaactgtcacttcgtcctgaaagtttgttttccgaaccattccggaaactccccatcaggggcctgatctgaggtttacccagattactagggaacccgctctgttccccaccccccaccccactgcacgtggggggtggtgaccacattcctgtcccagcgaggagcacagggcctccatccccacccacctgggggacaccagagaggggttccctagtgagagaggaggttcctcagacccccgcccccctgcaggagggagcaccagctccgtagaggaggggcagacgtggactggttcttgtcagggcagcagaaaggcccttggtgcgcttctcctaacactcccctatcctccgccgaggtcgggtggcccaggctgcagggctccagcggcttgctcacacccacctccctgcagatcacgcagctcaagattgccagcaatcccttcgcgaaaggcttccgggactgtgaccctgaggactggtgagtgtcctcccccgagagagtgagcgccgggcgcctggcgcaggcgccgccctgatccgcctcccgcccgcaggccccggaaccaccggcccggcgcactgccgctcatgagcgccttcgcgcgctcgcggaaccccgtggcttccccgacgcagcccagcggcacggagaaaggtagggccggggtcgtgggatccgggttccggccctgtgcgcgctctaccccgggccggcggcctcgcccgacctcgcctgcgcccccggggcgctccaggctttcgcgccggttgcacaacggccgcggcggcgggcaagcgcgcactcgcccgcccggcccgacggctgcgccccgcccgccgccgccgccgcccgcagaggggcgcgggccccggggagggctcggggcgccggcgacttggggtctcgggcacgctggcaccgactggtcggggaacaccgagggcggccaagagccttctctccgccagggcctcgcatggggcgtcggagctcctcggcggccccggccggccgcgctcactcctcggccctctccgcagacgcggctgaggcccggcgagaattccagcgcgacgcgggcgggccagcagtgctcggggacccggcgcatcctccgcagctgctggcccgggtgctaagcccctcgctgcccggggccggcggcgccggcggcttagtcccgctgcccggcgcgcccggaggccggcccagtcccccgaaccccgagctgcgcctggaggcgcccggcgcatcggagccgctgcaccaccacccctacaaatatccggccgccgcctacgaccactatctcggggccaagagccggccggcgccctacccgctgcccggcctgcgtggccacggctaccacccgcacgcgcatccgcaccaccaccaccaccccgtgagtccagccgccgcggccgccgccgccgctgccgcagctgccgcggccgccaacatgtactcgtcggccggagccgcgccgcccggctcctacgactattgccccagataacacgggccctgtcgcgctcccgccccggtcctgcacagccccgaagttcgccgggcccggccaccctgccccaagggcaagcaaggaatacgttcccccagccccaggggccaccgcggctctccccttccccagcctcgaagccatgggggccccctcgccacccccagccccttgggctatcgaagtatccggttccccagtccctggagccaccgcgggtccttccccggccccgagggccaagggggtccccgcccgccagtgccaaagcgcccggtcggaggcggaaggaagtgatatttattgttctccccgagaccgcgtcgcccgcggcccggccggcagttgcagtgtagacagcccgagagccccgcctgcaggcggtgtagatacatgtagatactgtagatactgtagataccgccccggcgccgacttgataaacggtttcgcctcttttggaagccgcctgcgtgtccatttatttgtgcccagttagatcgcgttgggaatcttcgggacagcgagcccggggtagctcagggccctcagggcctccccagccccaatccctgccgactgtaggtcggtcccggtcccacagcgccctgtccgccacgcctcctgccctctgcccgccccataggggctcccactgcccctcccctctccgaggcccctcctgccaggcctgtgcactccccccaccttcccaccgtcccgtctcatcccaacctccccagggctggtggtaccgcccaggtgtgcatcctgcctttttacttaaattcctcccacctgcagttgtccctattctgggacttgggcctgcgccctggcctgttttcgggacagatgcttgtgcttttccatggaagctgggaagaagggtcatgacagacactgccggtcggtgctgggagggggagaagcccctgaccgggatggggtcatggaaagacaaaaacaggcagcactgttctgctagcatttcccctgccggcctagcccaggcccgcatgttccctccttagtgactttatttgctgtgagtgtccctacggagtgacctggccagggggcacaatgacagtagccatgagtcatcttgagacctgtgtatgaagcatttttcccaggccaggtggctaagggacctctccccgttaactcaacaccagggatggggcgagaggaactctttgatccctcccttcctgagcgcaagcaggaagggctgacagccggtcagcgccaaggctgctgacttggacacaagatgaacgggaagtgcacgtggccgaggctctgtcccccacctcccgtgcctgtcccagtgtgtttgtggcaactgctgccttctaggccactcggctcatcaccccacgtggtagcggcagcctgagtgccacctctccgagggcacagccaggagtttccagatgtccaccctcgcggacctgtttttcgtatacatgtttgctctggcggcgtgaagtgagtggggtcttagtaattgaatggcaggaaccattcccagaggccagtctagggtgggagggggtctccaggggccatccaaagcctcaaagggcatctagcaccagagagtgaggacctctgcagcatctgcccaggctccgtgagcacggctttggagatgcatttggggggacggctgtggatgcccattcccaagtcctgatccccacctgcgtgaacttggggcagccattacccatgtgccccacggtgggtggggctttgcactgcagagggcctccctctcttgctgtcagaaggcagccattccgtactccacatccaggatgtgcggaggggctgccattcgagacctccgccttggttttgttcagagctaaagggaggaaaagccctcccctgaacaaagagcaaacacagtgtttgtaaatgagggtgggacacacagcaatgtgcaaggaccctgagtgtgcagcaaactggcctgttaccgtgcccctcctgttgggatggccatgcaagatggagcacccagccgtccagcagggccgccgctggccatccggggctgttcgcattctttttttttttttttttttttttttgagactgagtcgcgctctgtcgcccaggccggaatgccgtggtgcgatctcggctcactgcaacctccgcctcctgggttcaagtgatttcttttgcttcagcctcagagtagctgggactacaggaatgtaccaccatgcccggctaatttttgtatttttagtagagacggggtttcaccatgttggccaggctggtctcgaactcctgacctcaggtgacccgcctgccttggtcttccaaaatgctgggctttcaggcatgagccatcacactcggccacacgtcctaatgaactaggattcattaaacattcaggtcctcactggccccattccaggtgctccgtggctcacaggccgcgggtcaccacactgctgctgttgctgctgagggcactcccacgctgggcagtggcccccagaagtgtgggtttcctcccctccacctttgtagatgagtttgtgcatctgagaacttcttgtaaatgagagctcgcaggccggcgtctgggtggcagcttccgctggctgtgtgtctgcaagactggcgcacgccgctgctcaccgtccctcatgtgctcagtcctcaaccagtgcccagtgattgcctgcccgctgcgggggctgtctggctgatgccccagccactaccgttcctgtggaggtgacgttcccatgggcagctgccctaaggcctggcttccagcagcttcctctgtgacagctgtgatctgaacgttcacccccaaggtgatggtggcaggagatggagcctttaggcggtgattaggtcacgagcgtggagtcctcatgagtgggattagttgagtgctatgctgctcacagacctccagcctccagaactgggagaaataactgtccattgttgataagccaccgggcctatggtcatttgtcctagctgcactactggactgacagtggccgttcttccatctccttcttgttccctgttttaggttccccgttgagcacacctgccctgccccttctgtaagctgctgtgatgggcagtatggtgtaggggatagggggctcgtcccaccgctgttcccccacaggctccccctcagctgttggacttcccccaaacatcctcctccaggttccctagctggtccagaggccccgttgccctcccctagcctggctgcagacgtccagctgccaggactcaggaggacgagagaccagaagggcccccagactcctcactcccaaaaactctccaaaaacaacagatgcacaacgcaggaaatagatagattcttgactaagcgggggtggggaccatccacacccccttcacaccactgcatcccacggaagggttctaggaccccagggcctgggggtgcagctggacgatcctgcagtagccccgctccctgttttcagaagacccccccacggctgccctctgcagcatgtgcccctttgtcgaagggacaatgggcactccattgcccagagaggcttctcacccaggaaagcactggaggtgcagaggcaggagcacgcgggggcttggctgcgggacaaggcgagtctgtttggtggcaccttgagctgcggaggaagacaagaccctggcccggtggagatgagaccctggcctggtgggcttcaggccccaccctgcggcgcaccctccagctggggaagtccatggggtgtgtgggatccatgcgatgacagttgtatgaggctgaggccctgatctccaggtgtgccgcagatcaaagcacccgcataccagagaattccacgtagccacagttgccaagggcagaggcagcctcacctctcactggtggagggagagtgatgggtgaggagctgcttctaggacgaaagggatggctccagtgtgtcaggcagtgcaacccaaccaggagctgggcaccaggggagagcatgtggcccgtgttccagagactctgtgttccagagactcagttttcccttcagctgtggtgctgacctccgccctgtgtggagaagctctctgtcaacagtggaggcctgtgtcagccatgggcacggggacgttcattcctgcttctctcctccctgtgggttccaatgaggcggtgtgctcgggcagggtccacaagcatctgcaccatcctgcctctcctccttgccaagctccttcaccccccgccctgaaggagcatcctgcagagcctggccaaggagcaggtgggggcacggccccccagcctggcatagtggcacccaagcctagggagggcaggatgagacctttttccttggtgctacctcacacattttctggatttcaaaaaacacaactggtgcctttgattcaattccctttcctgcttgttgtactacttcaaaccagatgggctcctcagatgaaactccggagactcagtgtctctctttaaccgctgccaggtctgtgtgtgggaaacagcagaaccagaaatattttgctaaaaccagcccatgtgggggagaggcttagcttttaatagcagtaattaaattatcttcttaattataaagggtgatggcattgtcaacatgctttatctatcagctttcaattgcacaaagtaagcacgtaatcctctcctcccggccccactggcatcctctgctctgtggccagcccaggcccccttcctgcagtgcagacccccagaagctttggggtgcatctccccatttcaccagttctgaggtgcacagggttttttgcctgcatttcaacacctctgaagttggtgttctcttattcaaagtggggggtctcagcctaactgaaggatcttggctgcacatgaaaccatggtgcagtggcagttgccagggtgctgcagttgaggcccatgtcggtgcgcccactgtggcctcgggcaacgctgggtgccagcatgttgctctgggtgactttcttgcaggtggtgactccggcttctgtctccagcccttacagtggccctgtccttccaggaccttactcttcattcacatcatttctcaggacactcctccctgcacatccctagtcttccccatctcctcttcattcctctgtcattctagcttcagttcctctcaacagtttttttgtttgttttttgagatagagtcttgctctgtcgcccaggctggagtgcagtggcacaatctcagttcactgcaacttccgcctcctgggttcaagcgattctcctgcctcagcctcccaagtaaccgggattacagatgtccgccaccacgcccggctaatttttgtctttttagtagacatgggtttcaccatgttggcctttttttctttttgagacagggtcttgctctgttgcccaggctggagtgcagtggtgtgatcatggctcactgtagcctcgaactccggggctcaagccatcctccagactcagcctcctgattagctgggactacaggcgtgtgccaccacaccctgctaatattttgtagagacatatgagtcttgctatgttgcccaggctggtcttgaactcctgcctcttgaactcttggcctcaagtgatcctttggcctcagcctcccaaattgctggcattacaagcgtgagccaccgtgcccagccctcttctcaaatagtttttttttcccctccgtttctgaattcatcctttatctcagaatatgttttccggattactcccccaagacaagctttttttcttgtgacatcatcacagaacgaagatggtgacagcagcagggccacaaaacagtccccagtctacccagttgctcatggctgtggtttggaccttcagccatgaggcagtacgtcttcccagggcagggtagggaccttcaccgcggggctgggtctcaggagctgccgggcgcccttctccagcccgcctttgtgataagggacagaatcggggtcactggcaggacacaggtccccttccctgtcgcctcaggctggtgggattcctgcacccgagtgctgctggggctgcaggcgaggcctgggctacacaggaagcccgggcaccgcagagtggccgctagctggtggcattgttcctccacggattcagagcttacgagcacgggcgttgagctgaggcaaaatacggaaacagccacttccatgcaaataatcacccttctgataacaataagtcaagtctcaagggactaagaaaaacaagcagctttattaagatgcagctgaccgatctgaaagcctgcctgctccgccacctcctgggagagcctgcagggcccgagctctggggacaagagctgctgctcaggccccagaggaaggtctaggtgggaaatgggccgccaggaggtggacaccaacacataggagcacatcccaagacacccatcaccctgtgtggtgggtgctggaaagaaacagcctagttatgagagagacttgcaactgggggcaccctagcaccccacggaggcatttccaggtggcccctccagcttggctgtgtgggcttccttggaggaccctccctccaggcggccagccagaaggggccatctccaggcaggcacccccttcaggagagcccatgcccagtcactgcctgggaagcttactgcagggctggcccccacctgccactgtcacctcctgacctccacctgctctcctgggtcctcaggcctcacacagtcctgtccttctaacaggtgactgcaggatggagccccaggcatctcggcatcctgatgcggtcactgccaggaggggagtggtctcagggtgggccagacccctggacaccagcgtggtctccttcctgagctgccgagggagatttgcctggcaaagcccacctggcccctcggccctcagccgccgagtttccctcctgcagtgggaggtttcccacgactggagggaagcagtggctattccagtagtagctgtttctcatgcacaggtctcttccccagaaagaatttgagctgcaggacagagatcctatcacatatatacccagaaggtgattcaaggtgaatattaaagacttggatatccattaggatgatgatgattttaaaaaacaaaaacagaaaacaacacgtgttggtgaggacatggagcccctggaagccgtctacactgctggtgggactgtaagatagtgcagcttctgtggggaacagtgtcatgggtccttgaaaaattatacagttgttagggagagtgaagcaggaggactgcttgaagccaggagttcaagacccgcctgggcgggcctaggcacctgtagtcccagctactcaggaggctgaggcaggaggatcgcttgagcccaggagttccaggctgcagtgagctacgatcacaccactccacgccagcctgagtgacagagcaatatcttgtctctaaaatcaattaaaattctacatagaaccgtatgttccaggaattccacttctgggaaaatacccaagagaattgaaagcagagtctcaaagagatatttctccacccatgttcatagcagcattactcaaatagcaaaaggtggaggcgagccgagcgtccaccgataagtgaacggatcaacaaaatgtggtgtgtgtgtaccgtggagtattatccagccttaaagaggaagggaattctgttacatgctacaacagggatgaaccctgaggtccttatgctccgtgaattgagccggtcacaaaggacacattttgtactgtacaattccacttgcatgaggcacctcaagtagtcagattcaagaaacagacaggagaatggggattgttagggactgggggagaggaatggggagttggcgtctagtggggacagaggttccattttgcgttcatctggaggtggacgcacagcatcgggaatacacaatgccactgaattgtgtacttcaacatggtcacaatggcacattctttattttttgtagagacagggtgtcactgtgttgcccaggctagcctcgaactcgggttcaggctctccttccacctcggcctcccaaagtgctgggattataggtgtgagccaccacacctggccaaatttgtgggttttttggtttttatgtttttgaaacagagtttctcccttgtcacctaggctggagtacagtggcgcgatcttggctcactgcaacctttacctcctgggttcaagcgattctcctgcctcagcctcccaagtagctgggattacaggcacctgccaacacacccagctaattttttctatttttagtagagacggggtttcaccatgttggccaggctggtctcgaactcctgacctcaggtgatccgcccacctcagcctcccaaagtgctgggattacaggagtgaggcgctgcgcccagccaaaatttgtgtttttaaatgtatgtttaacaatttaaaaatcctagatcatccacagtttgcaaaagccactgctatccatcttggattgaccaattccctacctgcctctaaagcggtggttttttaacaggagcagtcttgccccctggggtgtttgacagtgcctgggacactgggtgggggtgcttctggcatctggtgggtggaggtggggtatgcttttcacctcctgcaatgcacgctcggaaccacaggtccggagccatggggctgctgtggcgaggtcttcccacatggccgcaccctgtctgaaggagctagtggtggggccccgaatattctgaggccaggagctcccaagtcccacctggcatgaagcggtgccccagggccctctccgcactcctccccctgcccaagtgggcccagactccccagtgaggccgcatggcctggagtgctcgcctggagcctgaggggtctggctgctgtgaggtgggcttcgagggtggctgccaggctgtgctggagagggctgggcatcagaaggctggtgacagccttgcagggagacggagggttaccggagccatccctggaggtggcccctccaagtgctcgggccccaggcaagtcccaccggctcccgagtggaaggtgtaagccacgtgggcacaggtgggagggagttctcaccacccatggctgctagtgcccctgaaaccacctggaagtcccagcggcttccccagggacaggcagtgctgtggcccgtgtccaccccagctctggggcctgtgctcgtggctccgtgtctgcccgtggtctccctctctctcaggggtggtttctctgtccctacccaatatggtgctctatagctttccttaggatcctagctcctcaggaggaagacgtgtggccccttgctccaggaaggcccagtcctccctcactgggggtgggagggtaaggcaaaagtgccaaagtgtccatcccatgaatgcaagacacacagtgcctgctctagaagagctcatgttccagcagggacagctaacacccaggggcctgcacggggtggagggctcttcagaggcaggatcacctcggagatgggtgcaggggacctcgggccaccccagggccaggcctgcttgccctgcttaggagctgggtctcccactcagggagggaggggtcatgtctcaagggcagccactgggcctgaaaagcagaaccgcatgtgatcagtctgggtgggcaagacttcaagagagcacgcctaccctcaagggatggaagcagaggctggtagccgacgtccatgccagccaccaactcagagccagcacactacccgcatgtgcctctgccaatgagtggatgaaaagcagcgacctacagatgcaggcaacctggatgagtcttgactttatctcacggagggaaggaagcaggctcgggaggtgccgtgccgcgtggctctgtttataagctgtctgggaaaaggcaaaaccacagtacagaacacagatcagccagtgcaggcaggaagggccagcacacggggtgggaggagcttcctgggtaacgctcaatcccatacgctacagagggcgcatgttattgaacattaaggtttttttaaaaaattttaatttaatataatttaattattattatactgttttagggtacatgtgcacaacatgcaggtttgttacatatgtatacatgtgccatgttggtgtgctgcacctattaactcgtcatttagcattaggtatgtctcctaatgctatccctccccctccccctaccccacaacagtccccggagtgtgatgttccccttcctgtgtccgtgtgttctcattgttcaattcccacctatgagtgagaacatgcggtgtttggttttttgtccttgcgatagtttgctgagaatgatggtttccagtttcatccatgtccctatgaaggacatgagctcttcattttttatggctgcatagtattccatggtgtatatgtgccacattttcttaatccagtctatcgttgttggacatttgggttggttccaagtctttgctattgtgaatagtgctgcaataaacatacgtgtgcatgtgtctttatagcagcatgatttataatcctttgggtatatacccagtaatggggtggctgagttctactcttataaagagcgtgctggcctttcccatgccttctcgtctgttttgacccattctgggtatcggtccttttcgtctccccctctccatcctctctcagcccctttcactgggtttcagtgtgctgggcacaggttcagggtgtgttgttactcttaatttttttttttttttttttgagacagggtctccctctgccccccagcctggagtgcagtggtatgatcatggctcacggcagccttgacctcctaggctcaagtgatcctcttacctcaacctcccatgtagctgggaacacaggcacgcaccaccatgcccggctaatttttaagttttttgtggagatgggattttgccatgttgctcaggctggtctcgaactcctgagctcaagtgatcctcttgccttggcctctcaaagtgctgggattacaggcgtgagccaccacacccaaccaggatttattactcttaactagtaaaacagcacattcctgctcatttcaagagacaggatcttgctctgtcacccaggctggagtgcagtggcatcgtgatcaaggctcactgcagcctcaacctcccagtctcaagcaaaccttcctcctcagtctcccgaacagctaggactacaggtgtgtgccaccacacctggcttttttgatgttgttgttgttgttagagatgggggtctcactatgttgcccaggctggtcacaaactcctgagctcaagtgatcctcccgcttttgccctccaaagcactgggattataggtgtgagccactgcacctggccattgctccttatttcttttctttctttcttttcttcttcttttttttttttgagacggagtttcgttctggttgcccaggctggagtgcaatggcgtagtctcagctcactgcaaactccacctcctgggctcaagcaatcctcctgcctcagcctcccaaatagctgggattacaggcatgcgccaccatgcctggctaatttttgtattttcagtagagacggggcttcaccatgttgggcaggctgatctcaaactcctgggctcaaatgatccgcctgcctcagcctcccaaagttctgggattgtaggcatgagccaccgtgtccagcccctttgaaaccccatctctactaaaaatataaaagttagctggacgtggcggcaggtgcctgtaatcccagctacttgggaggctgaggcaggataactgcttgaacttgggaggtggaggttgcagtgagctgagattgcaccactgcactccagcctaggcaacaataagactccgtctcaaacaaataaaataaataaaagtaggtaagggggagatctggttccctgatccgacgtctttccttggggtcactgactgtgggaaaggcctgtgctgggctgaggtgggacctggtgtggctgtggaggccgtgtctgtgtctgtgtcctgtgggcggctcggctcgttgggagatgcagtcctgtcctgcccttccatgcggttcagacactggacatttgtgcagtctgatctgcaagaaaagagaggcacctctgacatggtacttcatccactctcattggatggggttgtcacccaggtggacatgtcctgaaggacaaggaagtgaaagctgagacgtctaggaacacaccagagagagaagtggagcttctgagggatgcaggtggctgtgtgaacctggggctcccctgccccgcagagtgccaacccttcaatacccagggcctggtggctgggaggaccgcaggtgaccgtctttgttgaatgctgaggccgggccatgggcacatggagttgtcgtgtttcccttcactttggttcatgtttgaaatttccaaaattaaaaaaacagtgacttgttcagtaaattccaatatgaataaagtgcatgttttgtaataa

SEQ ID NO: 1072 - DNA, 10630 bp, Homo sapiens
ccggcagggggagcgaggaggaagggaaccgcggccgggccaggtgagggagggaggaacacttgccgcgggccgtgctgaggcgctgcgttcgcgtgcggaacccgcgtgtgccgggctagggccatccgacgggcgcgctccctccgggctgcgggagggcacgacgggtggggtggcggcaggtgaagaggagtgtgggcgggtggcggggtggcggggcggcggagcgcggcggggcggtgccctaggcgggagggagggtcggaggagccctatcctgctgcgcgatggaggcggtggaggcggcggctccggctggaggctgggacggcctcgcgcttcgagggcttccgggcccctttagccgagggctcctggagggtcccagcgttgagcaacggggtccgggggtccgaaatcaagcgagtgagtataggcagccggtggggtagggtcggccaacagagccggctgggtggggcccctcacctcttcccgtcgcccttctggttgaccagggtttcctccaccctgacggcctcttctctgctgtggcaagctggccgcccctgcctgcctgcaggtcctgctcaggcacgaaggggttaatgggggctggaagggctctgctcctccctacaaacctcaggcacagaggtctggggacctctggaccgatccttgagcggctgacccagagtctccaggaggccccagggtttttcactttcacttctccctcctcaatgttggcctcacccacaggccccacatctggccagtgccctgaggtgtgtgcagatgtacacaggacacaagcttgggcataccctcaggctggggcacatgcaggagccccacccccatgcccccaccgactggcccaggcctctctgggtgcagactgccaacacaggcacgtctcctgcaacactaccaaatctgcggccaccagcatccctaccacccgcctccacgggactgtccttcctgcaggagcagctcctggggacaatggctggtcctgctcagagaggaaggaaaggggcctggaaccagctggtccatccccacacagcactcctcactggacttgtccctgggtcccctcagtgacactgagagacataagtcattgtcactgtcatggcccagaatgactactcagggcaagaaaaatgcactaaggacagcttcccttttctgacatggcccacaaagctccagctgcaggcggcaggggttgtggggggcaggacatgaggcaccccatacaggcagcaacacacaccacatcccagacaggcagcactattcgtatactcacccactgcggccctggactcacatgcgttcctgaacctcaggcccagggccagcctccccactggcgcccagccccccagcccgttactgggccttcccagttcccagccagcatcctctccagcccagggtctgaggtcctgagatcctaaaaaccctgggagaggttgcctgcctcccactcccatcctgagcatgcacaagcgaaggctgcaatgaggttgtatacagagaggccttgcaaacagtggccctgaccaccagcaccagggaggctccagcaaggcacagaggctccagcaaggcacagaggcacagagctgaggttgacacccagctggagaggccctgtacaggaaagccatgggtgcgctgaactggttagaggagaccctggagacagtaggtggggaaacgcacaggccaagtcaggccttggcgtctgggatgcctgggcctagaaaccaggcagagcggcgggcctcggcctcactctgcccagcctggtcgggccatagagcttctcccggcaggcaggctggctgctgggtgccggggggcagcatacgacccagtggcctgaagttctccaacatgtcctcgtgtcctcggctccctcggctggccaggctccgcccccggccctccctgcgcccggccggtgcgcagggaggtcggaggagcgggcactgcccaccctccggatgtataagcgtcctggccagaggcgggcggtgcgcgcaagtgcgcgtgacgctcgggctcgcgggctgcgcagcctgggcagcgtccctctgctggggtctccagcgacgatagtgagccaacttcagggggctgttgggcatttactgggctgggtcctgtcctgctgcgccaaggaacagaggacgctgcggccctggggctcctgtcagtggccggtgcgagagcccaagctgccctctcctcacccaggtgcaggggcagccagggaggaggtggaggcgggaggggccaagggcaggggcagggctgggctccggcagccactcgctgcttcatgggtgccctgccacctcgggctagggctgggtgctgctggcatagacacctctcctcggggggctgtagaagctgacggtggcttcgctgcacagagaaaggccgtgccttggcaggagcaacgggatgttcaaggggcgttggtcatggaggtccctgggaatggaggaagggggcagggagcttggaaagcaagagggccctgcacttccagggtgctccacccgtctgggcccctcggctgctaccagccccaagtggggggcccatgacgccataatcctctgggccaggggcccctggcagtgagtggcaccacaggcccccgcccccggactccgtgggctgggctgggctgggcgcggtgcggctgggcacacgcagtcggaggcggcgccggccaggccgccgggcgcctatggacgcgcggagcccgctgtctccccgagccagtgcgttcagcatcgcctctctggttgcagcggaggcggcggagcgcaccgcccaccagggctcagggtcctccgaccgggtgaagcttcgctggctgccaggatccccggcagggatgcacttcagcaccgtcaccagggacatggaaggtgagcctccaggccgtgtctacactggcccgcccgccagaccccctgcctcagctgctgtggggcccgggtgcaaagtaggtggaggcagctcttggtagcgtgggctccaggcttctggctgcgattctggggcagagaggaagagccggcatcccgcccacagcctgtcccctcaccagcctgggggcccagcttggagatgggcactcaggtatacacaggcccggaagagggcgagtgaggctgggaaggagagcagaggtggccgtgagcctggagaggggggaggaaagttaataagagaggagagagcgggagagtttcacagaaggagagaaagcctcgaggaagccgtggagacgaaattgagcaaaggggagaaaacacaaaaaacccaaagaagaaggtaggggagaaacagaaggacacgaaaaggcaataaaaagcaagagcgaaagagaagagagaaaacgaagggaaaatttaagacagaaagcgaagtcataaaaaagaaaaaaaggaaagactttagtttttttttttttaaaaagaaaaacataaaaaacaaaggacatacaaaaataagaggaaaggcaccgactaaaagaaagacaaagaatgattaaaaataaagtgaaaaggaaggcgaggatggaggaaaaggggaagaggcggaaagtaaaacagaaataaagagaaactacagagataggggaagaaaaaagatgatcgggagggaaaatttaaatgaggacgacaaaggtaaaataacaaattaggaaaagaacgtctgggagagagagaggagaaacgcacgcgggcgggcggcagagcgagggccggccgacgggcccggcgcaccggtgagccggtccgggcggtcggggggccccgggccgagcgagccgcggcgggcgggctgggggccggggagggggaaggggcgggggaggggcgagggccgggggagggatctagtccattgtctccgcgcgggggtgggggggccccgggcggggcggggcggggcgcctcctcggggccggcctgcggtgtggggctgcacggcccggggcgcacgcagcgcggcgcccgccactcggcccgcggcgcggggcagcgctcagcttggtggcgggggcggcggcggcggcccgcgggtcatgatctccgccgtgtccagcccgtggctcacgcagctctcgcatttctgcgacgttgcagccttcacggccagcagcctgagcagcctgggggccgcggggggcttcccgggcgccgcgtcgcccggcgccgacccgtacggcccgcgcgagcccccgccgccgccgccgcgctacgacccgtgcgccgccgccgcccccggcgccccgggcccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggtcagggcgcccctccccacgccgcgaccctccccacgtgctgccgccagggctgcgggcctccgcctgatccgcgcgagcggggccgaaagccgggtcgggggcgcggcctggccacctgcgggcccctctgggccccgctgcctccttcgctgttcgccgtcccggctccggcgacagccgcccggcgctcccctcctaacacctatcctccgccggggcgggaggagacggcgcgggccgcacgggaacggcgaggagccccgcgggactcgcccgcccgccccgcagccccaggacgccgcgcggcccagaaaccggcccggcttggggcgcacccggctgggggcaggcagcggcgtccagggggcctcaccgcccggccgactcctagtaaatcccacctcaagaaaactctggttcagttctggagttcagtctatgcgggcaagataaagagcggcagccgggcaactctctggacactttcaggagaggattacccttaaaaacagcgtgcactgttgcgtggaagttgctacccagtttccttcaacctagatccctatagttgtggggcctggctctgtatccagcggcccgtcacctcccaaccggcctgtatttgttttaaagaccaagagacaaggggaacaagttttgcagatgcacccgatttgaccggtagacaaaggcgggtgccgcgctgtgtctaatgtacacaccagctcggagtccgaacagccaaggggagctcagggcctgtttgcaaagccttctcgtggtttctgtttccctgctgccggcgtcctttctgaggaacctgggcctgtgctctgctccagctctgtggtttttttccaggccctccttgctgtccccaggcacacaggccctcctgaggacagcggcagcccagccgctggctcaggccagcccggcaagggccttgtcggcgctgggcttcacccgggagcccacgtcccgcagcaccctccagcctgcagaggcttcgggtgggggagggagcgggcctgtcctagaggctggctcctggcatctgtcttctgcccaccgcctgcagggagttgcttgtgaggggaggcagaggggacggcaagtgagggccaatccttgtgttgtcctgaagggccccacggccactactgctgtgccatcatgtgggggtagcccatggcctacacccgtccaggcactgcagaatgtcctttcaagagccctgactggtcactgagccagggtccaaagcgggggagatttgaggaacaggaaagacacaaactgagtacactctgggtagctgcgtcttggggttatgtgtcttaaggggagtggaagcttgccctgtgccctgaggaaggtggggagactcttatcatggggccatgatagagaggggccctgagagtcaggggagggagggctctgagccttggcctcactgaggggattgggtaacagccgaagacccagctaaaagggcagcggggacgccttgaactcacacaggactacccggtttcactttgttggagccgggagctgcttcgatcaagctggggaggctctgctaagggcgcacgttaggcaccctgctgccggccgaagctgggaccaagaggccaaaaagtcagcaagggcgaggccgagtttatgtaggccaaggttgccgaaggtgggggctccagcgctgggctggccatttctgtgtccaggaacggcccaggaggctcccctgctgcgccaagctcccagttgagtaggggcctgcccagattagagcagctaagccaggaaagatggagcccaagggctgggacgacacagcagcccccagaggctggagggaggggccgagcagaggggccgccagccccaggcaggtcaaggggggctgccttccaccagctagggtgacccaaggcctcatcacccccaggcggatgtttcccaccttccaagtgaagctcttcggcatggatcccatggccgactatatgctgctcatggacttcgtgccggtggacgataagcgctaccggtgagcgagtggttgtaagcgtgagggaccgggagggcaccctggaaagtggcgggtctccgcctggtgacccaactccaagggtcgtctgcaccatgaaactctttaggcacctgcgatgctgcccgatcaacccgctccctcctccactcccatctgaccccagacccacaaccctactccatgccctctcagaacccgcctctggagccgcaggctgcagacagctcttgctcccctgggctggtgtggccctagggtggtcagccaagtactcagccccggacttcttcaagtctccctctcccaggaggccggcctgagcgcctagtccccttcccccatccccagggaactctggatcctggagctgggccggaaaggtggggtggccaggagagattatgcagggcgggcctcagctgcccggacaattaacagcaattaataaagagaacgcgcactgccctgtgcctgaggcccggcaaggccaagtgtgggctcccaccgcagcggcaccggggcgggaggacccgcatccagcgaaatgagatggcaggagcccagcctccccctctcggtgccccacagggtgtccagttccttgattgttttgagtgttggggtgggtgggagttctctgtttagtccatagtcccccttggaaaagctcccagcacatgcggcagcagagggttcaatctcacaggtggggaaacttctcaaaggcacttttagggttcgcccagcacacgggtcaaggccctctgggttcacctccacatgcacgaccccaccccgtgccgctccaggtacgccttccacagctcctcctggctggtggcggggaaggccgaccctgccacgccaggccgcgtgcactaccacccggactcgcctgccaagggcgcgcagtggatgaagcaaatcgtgtccttcgacaagctcaagctgaccaacaacctactggacgacaacggccacgtgagcgactgcctccccaggctccggtgtcccccaaggcctcgagtcccgaggcacccgcctgtccctaagaggcctgtagaatccccaggcccccggctgtccccaggcggctctgggctgtccccgaggaggccctttagagtccctgcgaggctagaggctgaggcggagcttgggcagtgctggtgtgccgatgaggagagcggcctctggtcaggggtcgcacagcctagtgggcctgggccctgggagaggggtcgccctccttctctcaccccactcctgattttatgcaggaagcttttttaatggaaaagatggggccctgcaagggggctggagaaagaggctttatggagtccaggccagtgaggtcgctgggcaggcacctaaggaaagagaacctaaacccagatcttttgccacttggagctcattcctggcagttgccaatgggtcacagcctcctcttggcccagtgacccagcctcatcttggaattaagggttttgcccaactcatccaggaaactcattgccaactcagacctcagcccatttcctggctcccaccccagatcctcagcccagccccaccgctggagctgattccccaccttgtcttccagattattctgaattccatgcacagataccagccccgcttccacgtggtctatgtggacccacgcaaagatagcgagaaatatgccgaggagaacttcaaaacctttgtgttcgaggagacacgattcaccgcggtcactgcctaccagaaccatcgggtgagggcctgtggggaggacctgagcggattcaacgcctctggaaaagcgggtgtaattttcagttgccgtttggggacagtgggtccgcttagacctgcaggctgtggtcccagtggagcccaacccaactggagccccactcccaagggcctcaggcagccccctccctctcgaggctggccggcccagcctcctatcagcttgacctctccagcggcaactgtcacttcgtcctgaaagtttgttttccgaaccattccggaaactccccatcaggggcctgatctgaggtttacccagattactagggaacccgctctgttccccaccccccaccccactgcacgtggggggtggtgaccacattcctgtcccagcgaggagcacagggcctccatccccacccacctgggggacaccagagaggggttccctagtgagagaggaggttcctcagacccccgcccccctgcaggagggagcaccagctccgtagaggaggggcagacgtggactggttcttgtcagggcagcagaaaggcccttggtgcgcttctcctaacactcccctatcctccgccgaggtcgggtggcccaggctgcagggctccagcggcttgctcacacccacctccctgcagatcacgcagctcaagattgccagcaatcccttcgcgaaaggcttccgggactgtgaccctgaggactggtgagtgtcctcccccgagagagtgagcgccgggcgcctggcgcaggcgccgccctgatccgcctcccgcccgcaggccccggaaccaccggcccggcgcactgccgctcatgagcgccttcgcgcgctcgcggaaccccgtggcttccccgacgcagcccagcggcacggagaaaggtagggccggggtcgtgggatccgggttccggccctgtgcgcgctctaccccgggccggcggcctcgcccgacctcgcctgcgcccccggggcgctccaggctttcgcgccggttgcacaacggccgcggcggcgggcaagcgcgcactcgcccgcccggcccgacggctgcgccccgcccgccgccgccgccgcccgcagaggggcgcgggccccggggagggctcggggcgccggcgacttggggtctcgggcacgctggcaccgactggtcggggaacaccgagggcggccaagagccttctctccgccagggcctcgcatggggcgtcggagctcctcggcggccccggccggccgcgctcactcctcggccctctccgcagacgcggctgaggcccggcgagaattccagcgcgacgcgggcgggccagcagtgctcggggacccggcgcatcctccgcagctgctggcccgggtgctaagcccctcgctgcccggggccggcggcgccggcggcttagtcccgctgcccggcgcgcccggaggccggcccagtcccccgaaccccgagctgcgcctggaggcgcccggcgcatcggagccgctgcaccaccacccctacaaatatccggccgccgcctacgaccactatctcggggccaagagccggccggcgccctacccgctgcccggcctgcgtggccacggctaccacccgcacgcgcatccgcaccaccaccaccaccccgtgagtccagccgccgcggccgccgccgccgctgccgcagctgccgcggccgccaacatgtactcgtcggccggagccgcgccgcccggctcctacgactattgccccagataacacgggccctgtcgcgctcccgccccggtcctgcacagccccgaagttcgccgggcccggccaccctgccccaagggcaagcaaggaatacgttcccccagccccaggggccaccgcggctctccccttccccagcctcgaagccatgggggccccctcgccacccccagccccttgggctatcgaagtatccggttccccagtccctggagccaccgcgggtccttccccggccccgagggccaagggggtccccgcccgccagtgccaaagcgcccggtcggaggcggaaggaagtgatatttattgttctccccgagaccgcgtcgcccgcggcccggccggcagttgcagtgtagacagcccgagagccccgcctgcaggcggtgtagatacatgtagatactgtagatactgtagataccgccccggcgccgacttgataaacggtttcgcctcttttgg

SEQ ID NO: 1073 - DNA, 5371 bp, Homo sapiens
gaatggctgatgtctttattctgagggtgagaggctggcaccctgtggacccttgactggccagatcccctcctggggcctccctgcaggctggaccctgcctttgtaacagctgagcagcaccccagcatggccccttccttggttgatgccctctctgctgggctgagggccaggctggccacagaggggccaactctgcccagtgttctccaccccatgcccccagctggtgcagttcccagacctctctctgcctctcctcaagtttaagtatcaaatcgaacattcttttttaaagtaagctctgccctgactcccccagccatgcagagaggcttgcagagctgcctaggcctagtttggccctttccctggcacccaggccctgtgttcagacccctggctctcatcacagaaacaccctttgttgagcagttgtttattctggccctcacagccttggctagtccacaaaggccctggggatgggcaacaggctacaggaacccacctgtcttcctggtcagggcccctggcccctagcagcaggccaatcctggtggggcacagggttctgtgccctttggctgcctacctctgaatatcctggccagcaagccatgccttccccgcccctggggccctgggagcccttcagctcctgtccccataatgggtcctgggcctaggatgaggggaaggtcccagtttcttgtagggtgttatctgggggtcctggtgtgggttgagctggagggctgtggggccccaagacccctgtgccattggggtgctccaccctctcaaacaggatgagcatctcacagtgcggggtctgcgggaacaggtccactgccacagccttgaccggccggaagggaatgcccttcacccggttagatggggctctgcagaggctgtggggggaaaaggggggcgctaaggtcagccgataggctaatcaggggctcctgtgggagctgggggcttggtagcaggcctagcccccacccaggcccctgcagacactcactccacaaagttgcccatggctgcccgggggttgcatgagacgtacagcagccgcctgaggttcttagctctccggatggccaggatcaccttggaatctgaggaggcaaacaccagctgggtccccacagccagagagtgcataacatggtgagccaccccatgtgtcctcgttcccgtgccacctccttaagcaaaagccactcacgcaagccagcacggggtgggtccaggatggccacgaggtgctgggaggccagtctgctcaccagggtgggcaccaggtcctcggccctcccgcagtggaactccacattactcaactctgaagagatggcaccgtggcctgtcagagggccacatgccctcccagcagggccagccctggggaacccctagccaaagagcttgctcacttgctctacctgtcgggcagcccccaagccctggctgtggctgaggcttgcagcaggggtggcggctgcccccatccccacccccacccacggccttgccactcaccattgtcctgggcgttcacccgggcgtcctccacagcctctgggcatagctcgaccccaatgaccctctttaccttctgaaacaggaaagcgtggtgtcgccccacccagggaggggagtacatggggccctgtgggcagcaaagaggagctgggcctggggcatgatggagtcagctgtggtgactttgagctggggtcaatgggggtcttggggtggggagagggtgccctcagcagggcaggagggctcacccgggccagggccaggccaatggtgccggtgccacagcacacgtccagcaccatgctccccgcatccaattgggcccagtcctggatgactgtgtagagcacctcggctgcgggtgtgttcacctgggggcaggcggtgcccaggatgtcagtggctcctctcctgtggtgccactggtgccccgacgcccacattcctggtccctccatcctgccgggacctccggcgcccactccccaccttggtgcccaacgtcttccctgaccccaccttggaccagccttgctgatgccctcatccagcccctggctttaaaagccaagcccgtgctaagcacagcctcctccttgccccacttggttgagggctcatgaggccccgcaggccaataggctgtaccttccctgccccagcaagggggctttgcctcccacaactcacaccggggcccctggaatcacccaactgcagctcccacccccacacctagccctccaggaggtcctgccaggcctgtctccaaaaacggccgctccaggtccccacagccttcctgcagcagtgagcaaacagtgaaacagtatttcccagcccagaggccaccatggcctccctcctgccgagcccagagcagtgccctgtggtaatgcactgagggccactcctcatcctccctgtgacaagggccactgccgtgtgtacctctaggttatcccgagtcaaatcagtgatgaccaacctctttcttacttcaccctcccctgtggctcacctgcctggatactcccccaaatctcaccgcctgagcccactgttcccatcacgtcctgatggtgcgtcaggcctccctcaacatgtccccatgcccaccagggactcatggctacctggaagaaggcgtgtggagagatccggaaggtcagccctagcaggtcctcgtggatgcaccggtccccagccacatgctccaggggcaggccctcctggctaggagtctttctgtgggcgaaggtgcaggtccttcagtgtcacagtccctgcagggacctgccccgccccactcgggctccttaccgctgtccctcctccacgaagtagaggcaggtcactccactggccctgcctggccctgctgtgaagtgctgcgctagggaggtcttcagctctgccagctcctcagggctcagcttctggagtaagtggtgaaaagttcccatcaggctgtgctgaggcccacctaggctaggcaccctcccccagcagggcccccgttgagacctgggggtggaagtaggcaatggccatggcctggtggcggcggctggtgcgcacagtcagctgcttccagtggcctgtgtacgtctctgggtcgtatgccgagtatggagtggacctgtgggaatcacgagctggcccaagtgcccacaactgggcaagcagtccccctgctctctcctctggccacaccttccttcatctggctgaaatggcaggcactccagaattcccggggcaggatcaccaccctctgctcccacaccgcataggacttcccgggagccccgtcacaggtcctcaccggatgaactcctggaaggccttcaccacctgcttggtggcttcggggatgtgcacggtgtcaaacggggctgccacagcacacgtcccgcccttgtacttgccgagccgacagcccacggtgttatcctccccatccaccccgacgccaaccagaaactcacacttattacgatactcagtctgcagggagagagagctgcaccttaccctggctgcccagcgcttgggcctggaaaccctgatttccccacaggggctggcagtcaaacaagaggaacagctgacaactatgtgatgttaccagaagaaaacacaaagcagggagatcaacaggaagggtgagcaaaagcaaagtttttcaaaacccaggataggggtttgtggccaccgaagtctagtctgacctgctggggtgatggcctgaccccctccagcgggcagcaggccttgttgtgcttgtgcctctgctcgagcagccagggcagcaaggcacggttggtgctcccgatttccctgtaagaggagcagatcggtggttggactccacctactgcccccgacccatgccaggccactccccaaatgtccaggctcctgacccctcctttgggatgtcattgtgcccactgtgacgtgggtgtcttgctggctagctcccaaaggggccgccagatcctgtgctgggcctcccaactggtgcatggacaggctgaggaagcacaggccgggcagagccctggccaagaggggcgtcttgcgcccacactcacttggcaagtttctgcagcacctgctcgcactccagctgcttccgctcaagctgctcagcatagggcactgtccatagaggggtcaccacgtcggccactcgtgttactggtggctcactctcaccctcctgtcgcctcctcctggccatggggtcggccttgggccgggccaggcgcacactgagtgggcggcctttccagagggcaccatgcaaaacgcgcagggccttgtccctctctgcagcgctgcggaatgtcacaaaggcgcagggtggttgcccaaagagtttggttttgtggggctgcagaccaaagcggcccaggaagcgccggacgtcgctgaagctggcgtggcgaggcacgttctgcagctccagtttaaagatctcagaggtaaacaagtcatccctgatgtagctgtagagcccgggctgaggccccggccctgtagccgccccagcgccctctttctccacctcctccagggctgccggggctgcagggggcaccgagacggtagggcagctcagggcactgctgctctcctggccacagctctccatgggcttcgggccctgtgtggggacagatggggtgctagggtgaggactaggccctgggggcctggccccccaagcttccttatgggacacccagacctccgtcggtgcactctgcactcagccctgcccctcccccagtctaccctcccgaccccattcccgtctcctttcctcccctatcgcacctgcctcgtccccacctattctctggcaggtttcctgacccaccccgcctcctcccaccccatccccgtctctacccagcgtctccccgcactctacctcgttgtcgaggttctcactcatcgcccaggcggttctccgcctagaccagggacgccatgggggccgcctggccacctcgtcctgggcctgtcacaagggaagtggcctgtcacaagggaagtgctcagaggggaggtgctcacagagccggtgcaacgccgcgaggtcgccgccacccccggcttcgccccaggcggggcgggactcgaacctgcgatgctcaggtccgggtctcaggcttggggctgtaccgcccgcccgccaggggcccgcgccggccgctcgcttcgccagccactcttagtccgccagcgcgtgcggcggaggccgagcgtctctatgatcctggcttctggcaac

SEQ ID NO: 1074 - DNA, 5371 bp, Homo sapiens; identical to SEQ ID NO: 1073

SEQ ID NO: 1075 - DNA, 1816 bp, Homo sapiens
tcaatggtaaggcagtgctgtggaaatctgtctgtgtaactggggtgctatgcaggcctgtctgggtgactgtcagggacaactgtcctaccacaccaaggacacagccctgggggtgcttttcttcatagccaaagaagctgcaggaaacccaccctagtgggacaaagaccaatgcagggtcagtccccacagccaggtgatgcaaacaggctggacgtgggccgcctcccctccagcttgacttgtgacagggaaaccaatgcagcagcagcagggccaccagagtcctgtcctggggacaggcttccttccagcgggcggggagtgggtgctcctgccagaccagcctggcttccacggttccagagaccctgttctccctcagcccagtccccgcccccactccttggctttatgagttcattggctgaagtcacccggagacaatgctgagtgttccacccctgagtcgaagcccagcccagggcagcccagccagacgcctccggtagtgtaaatgaggacaatgcctgctggcccacatgacggggggatgtagacggcagcggcgccagtcgctcctggcaccatggacgatgccacagtcctaaggaagaagggttacatcgtaggcatcaatcttggcaagggttcctacgcaaaagtcaaatctgcctactctgagcgcctcaagttcaatgtggctgtcaagatcatcgaccgcaagaaaacacctactgactttgtggagagattccttcctcgggagatggacatcctggcaactgtcaaccacggctccatcatcaagacttacgagatctttgagacctctgacggacggatctacatcatcatggagcttggcgtccagggcgacctcctcgagttcatcaagtgccagggagccctgcatgaggacgtggcacgcaagatgttccgacagctctcctccgccgtcaagtactgccacgacctggacatcgtccaccgggacctcaagtgcgagaaccttctcctcgacaaggacttcaacatcaagctgtctgactttggcttctccaagcgctgcctgcgggacagcaatgggcgcatcatcctcagcaagaccttctgcgggtcggcagcatatgcagcccccgaggtgctgcagagcatcccctaccagcccaaggtgtatgacatctggagcctgggcgtgatcctgtacatcatggtctgcggctccatgccctatgacgactccgacatcaggaagatgctgcgtatccagaaggagcaccgtgtggacttcccgcgctccaagaacctgacctgcgagtgcaaggacctcatctaccgcatgctgcagcccgacgtcagccagcggctccacatcgatgagatcctcagccactcgtggctgcagccccccaagcccaaagccacgtcttctgcctccttcaagagggagggggagggcaagtaccgcgctgagtgcaaactggacaccaagacaggcttgaggcccgaccaccggcccgaccacaagcttggagccaaaacccagcaccggctgctggtggtgcccgagaacgagaacaggatggaggacaggctggccgagacctccagggccaaagaccatcacatctccggagctgaggtggggaaagcaagcacctagcatgacaatggccccgttgtgtgtggtgggggtcggggttggggggcatggtgcagtcggccttcacgtaaactaagtaggcaggtaggatctgaagaaggcacaggtgcaagtaaaattcgtcaattaaaccactattttgattac

SEQ ID NO: 1076 - DNA, 66320 bp, Homo sapiens
cacacttcagaaaaagtaccctctttatttgcattgcagaaatgccagggggctcggacatgggtgcccacagggtaggtttccacccaggtcgtcatcatctggcaccaggagcctgggggggggtgcccggcggcagaggctgagaggtgcaggggtgaggtggacagtcccctgagccatccctgtggggcacacgggccacctgtccagcacttgcgctccacgctgaccatctcacaggcgctccaggagagggttgaggccccccaaacctggcctgcagccatcctgccaacaacaggaaggtcagcacaggtcagccacccacccctcacatcagcctagctatgtctcccactgccacacccagggacccccaagggagatgggtgagaaataaacccagcagagaatggccccaccccagggcgatgcgtcacagggagcgacgcggtgctacaaaaatattttgaaatgataaaaatttatagcaggctcctaacaaaacagctctgggaggtgtaatgttctgataagagtttcctcaggatgccctttgtttatccctatcgagcgcggccccgccggggggaggcggccacggtgaagcagggggccctgagtacccccagagaggcctccccagagcccctcggcgccatgcagaccctagagcctgtccacaggcatcttggggggagcccactgctctgcctggtctccacctcagccccgggggagagatggagcccaaacaccccaaccctgggaggggctgacagccatgggggtgccccaggtgggctggatggcacgggctgagggcccaccctgccccggcccctgccctgcagcccaggccggaggatgcactattagaccacgaggcgagggggctctggcacaggcatccctggggcagaggccaggagcccttgccagtttcttcctccccagaagaggtcacgatgaacaacatgccccccggtcagcctggctctgcagagctggaacagaaccagatgtgcagggcaggctgggcagggccggccatcacagggcagcgtctccaccttctgggagatagggaaatgagcgggcgctgaactctgcaggagccaggccttggtgggaggcctcggtgggaggccagcttcccgactgcagccccctgtggggcagcaacttgagatgcccgactttagcccacccgggacaccttccacgccaacatccacctgggataggctgctaaggatgagccccgtttcttgatacctcctgtgtgtggggagcagctgtggccaggccggggtctggggtcccccggggaggtttgggcccctgggaacttccccttctgcctgtcaccgctgtggcctggttacaggatggagcacccattctgggtggcgtggcaggtgtagccttgctgtacacctggagggagcccatggccagggctcctgcacccctgccacatgccctgtcctcaaacagagccagccccacctgcatacctgggtctggcctccgaggagctggcggcgggcgcaccgtgtgccctggcctgcagggatggcgcttaccctcagcagcctgtcaccgtggggtccaggcctgagcgcttggagatgcgcagcttgactacctcctcagagcatgtgggatggatacccacggtccgcatcacctgcgcataggaagccccacacctgcacatgggggatgggggaggcaggcggggtcagcacagggaggggggtccacagcatcccacccccgggaagaggagggcctcagaggctgctggtctcctcactgtcccctgacccccagccagcagccaggacccctgcccacacccgtgggtgccatccacctccctcccagcagatgcctagtgctcgtccagcccacctcccacccagccacgccctggcttgccctggcctggcttcctgctgttccatcctcccctgctaggcacagtcctgccttaggcctctgctctctgctttacccacagacagcgcatcctggcctcaccacaccaccacctcccaggccccacatccagccagccacctctctcaggccatgcacaatgtcccaacctccaactacccctgtcaacccacccagagcctttgccatggcttcctttgaccccgggaccccgaaaacacacagcctgagcccaagacccaggcaatggccccagctccagaagacacacagcagccctggggtggctctccaggtactggcactctgctcatggtggcgtggtgcttggccaggtgggcaagggccctagcagcgacccggggccacaggggacacctcacctggctctggctggctcaacagcgtctggctggggcagaaccgcctcttgtccccctaaaacccgccctgtctgaggggcctgaggaatctctgctgcaaacccacgaaggccacataaatgccgcaagagtggcagcagctctccactgtaggactgccggcactcgagggatacccagctgcacatcgcatcgcagcctgcattcctcgggacttacttgatccccagagcaaatccttgagtaacttcgcctgcgttggggccaaggaaatgcaggcccagcaccagctgtgggggctccctcaggcacaccatctgaaagccgcacatctcagccaccagcccaggagggggctgggttgcgtccaccctgcatccaccctgcaccctgcctgggaggcatgggtggggccagtcctcgggtgttcaccctgccaggctctttgccaccctccctctcatcctcagcaccctgggccacagggatgctcacctttacataacactgggatgcatctcgtccagccaccgtgaactccagtggtttataatgggcgtgatagacctgaggacaggataccaaccctggatcagtgctgcgacaaacaaacctcgtggcacctgcagctcccacaggctgcatgggcaaggcagggtcatggcgggcaggaaccatccatctggcctgaaggtctggtctgggatggggatgagggcttggctggccacggggtgtgtgcaggccctctcacgtgcaggcagccagtggctggagccatgctctgcaggacagaccctgtcccacccaggcctgggacccccgtaaaccacagcagcagagcaggcatcaggcaatccaagcagccaggccaggcacagcaaacctgggtggacgtagctcacccacaacaaatggtggaggcaagaatgggtgagcaggaggccacctgggctccctcaggcaccctggtgtttgcttggccctcactggagcaaggccgctgtggccacaccggagccggagctgttggacaaaggctttcagcacccctgaagggctcgacagcgtgtccggggctgcggccaagtaaaaaatgagtggggccctcacatgtgctgtacagccattattaattaatggaacttcagagaatattgttctaactaagacagaattgaaaagaaaacaaacagagtatttggccattcaacattgtgaaacataaaacaacattataaaatgccaggaacatatgtcccagcacacttgtgatgaatcaaacaaaaatagcaaataaagtgcctcggggaaggctggcctgtcaggcccgtcctgttgatggagagttctggggtgcagggggaaggggccagccctggagcccagtgtctcatccccaaaggccgcaggccccaccgcccaggctgcaggctccggtttctctgggtgcctgcaagctgcagcggcagcaagatgaaaccgcaccgaaggcttccagctaccacggcccggcaggcttcagagcccccgcatccctccaggccaccccggagccacagccacctgccagagcagacccccaaagcaggcttgctcgatgaaaacccctttcctcaagggtgagtgcctgagcctggaagaagctggaagaggatgggtatcaggatgtggtggggggcggggggcggggggctctcgcctgggagaaaccctgggcagtccaggaagacgaggtgcagggtggtggggggggtgggggtggaagcagaggtcggaggcccctgggagaaacttttctgggtagagtgagattcatggccctgcaaggtggggacagcacagaggcatcttcggggccctggtgctttcagggacaagctgctgtgtgctggagtggggccagtgctcagctgacctcagcaggggagcgggtggcaccgtggtggtgaccctgctggtgctgggcacccctgcagcatggctggggtggggctgggggcttctgggccacagggcttctccttgccctcagaacaaggcagccaagggccttcccctcactgctgtgacacatggtggcagagaccagaggcacctaagcccagtcaccccaaggctgccaaagcccaggcacccccacttctgaggctgcccccaacgtgtcccttcccgctacacacagccactgctcagggcccctggaaaggagagaccttggcaccctgctcacaaggcctccgcccagagcatggggtgaggtcgtggagtcgccactgtcctcagctgtgctgctcccaggcctcacctcaacatgctcctgcccgtggcgagccactgcctcctcctcggacagccccacacagccatactccagcggggtgaagacggtcgtgggaacctgaaagcaggtctggagtcagggagggcccttgggccccgaaaaccgaagttccccactgcatgtgacacaaagagcagcgatcacagaccaggaccagatgcgcccagagcaggctgcaagcacagtaggcgacccacctgcccacgcctgcgccacactctcagaactgagccacacacccatgcatgcacacacacgtgtgtacaacacacccacataagcgcacacacacgcatgcccacatctacatgcagacacacagcgcacaaaggcccctcaccccagaagagctagcctcgaactcagcctgtcctaggctgcacgtggcgtcctgctagagaactcacattgtcgtagtccatcagatctgaggacccgccgaagagccgctgcaccaggagcctcccggccatgatcgctatgggtgtcagctcaggccgccccttggggaaggcacaggggggccacgtcagcaccatgtccggggttatatgcagcccctatgccatcaccctttgccctccgagtgggcatctccctttagaaaatccccaacactggcaccgagcatggtgacgtacagcattccccctagagctcgtcctcctgaggggcatcccaaggacctaggtaggttgctcattctcctgtttgctgccctccactctgccctgggaaaggagtccgctgctgatgaggctggccgtgccaccctcacatgctcaagccttctctccaaaccccttctgcacattgctgacctcggagggctgccccatgaccaagctcaaaagagcccctgctaccgttttcattcactggaatccccggctaaaaagggaccccaaagcgttccatgtgctcctgacgtgcagcttgatctgcacgtcacagtccataacaaattccaaatcagaatgtcgctgtgctggagatccctccgtcccagggtgtgcccagccttgggggttccagcaccgtcctctgggatgggctgccaatcaccatggcagcaggaaatgcagatgttgtttggcattccagaaatgcatagagatccgtggagataaactcagagcgcagcctgcgcattccagcaggcctgactaactacggaaacatcccggcgggcggcgcacagcacacaacatctcattaaacaatagcccccgccccgcccacaggctcttcccagccgctcaagggaccactggttgggtgttaactctttggactattcagaacgacctttctgacagagtggatttaatgtttaaataaagaatgcctttgtgtgcgccatgcatttctggcaaaacggtttgaaatgttccagtttccaacacaggagcctgggagctacacacttgcagagggaaaactcagattcccagacagaagggaggcttcccgctgtgcacagagatgcacatggcactgtctcagggtgcagcgcccacaggattcaacagaccctgcaaccagagaccactgcacctacatggtccacaggcagaggctgcgcttgcagaaatcactgagcagctgaaccatccagctaagcaagctggggctgcagggtggctgaggcacatggagccacatgctctgtccacacaatcgggtcggctagatgggccctacaggaccctgcagggtctgcctggagcctcagagtgtgaccttatttggaaataagatctttgcagatacaattaaggtaaggatggaaatgaagtcatcctggattagggtggaccctaagtccaattgcagagaaactgtaagaggcaaatcagggcccagagacacacccaggagactgtcacatgacgatgaggcagagagaggagtgatatagccacaacccgagggacgcctggggcatcctaccccagaggcttccgagggagcctggcccagctgacactttctgacatggagtctcgctctgtcacccaggctggagtgcagtggcacaatcttggctcacggtaacctccgccttcctcctcccgagttcaaatgattctcctgcctcagcctcccgggtagctgggattacagatacgtgccaccacgcctggctaatttttgtatttttttagtagagacggtttcaccatgttggctaggctggtcttgaactcctgacctcaagtaatctgcctgcctcggagtcccaaagtgctgggattacaagcatgagacactgcacccagccccagctgacactttcatttcagactactgccccccaaacgtgagataatccatgtctgttgttctgggccacccgtgtgtggtgatttggtaccacagccccaggacgcagacactgacaggtctcgctacaaagaagctctcagcgaccctccagagccactttcagcagcaggtgctggacacatgcaggacaggccgagcactcctgaggctgccagggtgcagtatcccaagactgaccaccacagtcccttactggggccatgtgtaaggagggctccagagcccccacccaggaaagactggcaccggtctccacttcacagcagcagcagcagctgagagcaaaggacctgccccggtgtgatgcccagagaggcaagccagaggatactgaggcggggagggcggggccaggtgggcccgaactagacctgcctctcaaccctgtggggacaggacggccccaaggccatggtggcatttctaagcctatgcctctagcctacctgccaggggttgaggcctgcgtgcagagctgacccatgccccattcccagcaggcgtctgctgctggtgcttgcagctgtctttagaccatccacactcccaccacagaaaggaaaggaaaggcagagagccgaggcccatgtccaggttgccccagaactccagacaggctggccctggggtttggcccagagcctctgtcatcagagaaagtgtcgtttctctcctacaggacggcagcagccggagcccagcgagcaggggtggtggagcaggcaggggcaggggccctggtcccgggacgcatgccgtacctccaccacgtcaccaatggcgtagatgtggggcacagaggtggcttcccgggagtccaccaggatcttctgagtgtcggggctagtatctaccccagccttctccaaattcagacttctggtgtctgggactcgacctgaaggaaacagagagggggctgaaaggttatcttcagtggctttgacctagagcggttgtgtttaaactgtttctcagaatgtccacttagagaccgggtgcagtggctcctgcctgtaatcccagcactgtaggaggacgaggtgggcaaatcacctgaggtcatgagttcgagaccaggctggccaacatgatgaaaccctgtctcagccaggcgtgatggctcatgcctataatcccaacactttgggaggccgaggcaagtggatcacctgaggtctggagttcaaaaccagcctggccaacatggtgaaaccccatctctactaaaaatacaaaattacctaggcgtagtggtgcacacctatagtcccagctactcgggaggttgaatcgcttgaacccaggaggtggaggctgcagtgagctaagattgcaccattgcgctccagcctgcgcaacaagagcaaaactctgtctcaaaaaaaaaaaaagaaagaaaagaaaagaaagaaaccctgtctctattaaaaatacaaaaatagctgggtgtggtggcatgcacccgtaatcccagctacttgggagggtgaggcatgagaattgcttgaacccgggaggtgtcggttgcagtgagccaagatcacaccactgcacttcagcctgggcgacagagtgagactgtctcaagaaaaaagaatgtccacttagaactggccaaatgtgaagcaccagcagcgtagaggggctcctggcctctgcaggaggtggcaggcaggtctgaaacggacactggtcagatgacagccggcacaggagacaaggcaggggtgccaccggtggaaactggagtcggccttagactggttcctggcacgcgggaaaggaagaggcacttgccaatgctggggctccctgacatcaaagagtgctaagcgcgggactccagaatcttccgcatgcccaggcctcaggccctgctgcagggccaccagcacagtgccagtggctctggtactgacttcatccggagaaaccagcccttcatggggagctgttggcacctggcctgcctggcctccctgcatctgtctgcagcaccacagcctgataccattaggcagtgagatccatcagctcccaggcctcaagagtccagaggggcctccttcaagggacacctgctggctcccaatggcctcctccctatctggacaagctgaagaggagccagccacaccctggactgtaccccaacaatgctcaagtcctgggatctggccctctgcccaggtagggcttgaaggtctctccccattaggagaaagcaagcccccgtaacccgctagtagagggccaggtgagcagagctagcagccgggtctcccacctgctctgtgctgcagcccctcgtggctgcctggcacacagtcccagcctagagacctcagggccaaggggagctgagctaaggggcagtgtccaaactacaccgtgcccattctagggggcagctggctcagctgatcctgctcttgggtgcaaaggccaagaggggcaggggatggccagtccagggggtcagcacagctgccccctgccagtctccacacagcctggggcccggagagagggcaccgcatgggcctcttcatagccgaacagccagcagaggtccctttctcccctaactcagatgggtgtgattttgccaggccagcggatggccacagcagcttttccctcccaaccccaggtgctctcggctcccaggggctcaggatgatccaccaatggcgaaggcaattttgcctcaaaagcatagctcccctgctcatcgtggctgggacaaaccagctgctggccggtatgcgggtggcgcccacctaagcatctggaagctgaagctcccgtgagagggaacccttaagtctccagctgctgtcccggggcaggagtcaaaacataccaacttggctaagccagcttgcgggaggccggctccagcctctgtgctctgctcagccgcaggaattgggtgccgggagggctggcaccggtcggggatcagcccagacacaggggatgccagcccacatcagaggaaggagctgggccccatgggcagggctggggcacgaaggaggggctgtggtccctgcaggccgggggctcacgctcagccgtctggtccctctccaacctggtgtccagcccaccaggcccagcacttcctggtgcctgctccgtgccggaacagaacatctgacgctgcacccacactctcctctgcacgcttgcctggctggtcctgggaagccaagagcactcatcatgttcctcatggtaactatggcactatggcaactacagaccttgcaggtgctgaccaaaccctgtccccaggtcccgaaggaaataaagataaatttaaaagtagtcacaagagataaaagaggcatggaaataggtggcccatccaaagccaggactcttccgcacatgctctgtggatcactctgggaagtcggtgggaatgtaatggagccactaatgtgaaaggcatgacagctggacaggctggatggccaggggagagtgggctgcgcggcacagacacgcctggccctgcagggactccacagcccttcgggaatgaacagcaaaagaagagtgagtggcctgtggcaggcagcaggctcagccctgaggagggcagccgagggcacagtggggttagaagctgggctggtgggacgtggctgggagtgggtgcagggaagaggccagctccacttgggtggggccacgtccctagccgtggccagccctgatggcaggacaccaggccctgagccccactatgggtcttgctgagcaaaggactgggcagtggccagagaagggccagatctccctgctggtgctggacagccaatcaggcgtcctaggccctactggctcaggcctggagccctgcaggaggttggacgacttgtgccaaggtggggacccactggggcccgaatgctgtgagcagcaggatgcaggtggctgtgcccagtcagctccccaccatttccctcctatgccaggataaagcagttgtgcctggtcagctcccgaccatttccctcctatgccaggataaatgtgcactattcaggccatttagggaaagaagggtgcctgcaccggtgtctttcgccctgcatgttgtgctcagagctttcccagctgtgcctgtggcccactgcaggcctccccatggggcggctctgtgctccctgcagctccgtcctcgaagccttggctctggagtgcccagtgcagcatttgccaagtgctgctgaatggcccctcctggggtaggacaggcactctcaaggctctgcttcctagacaccaccaggatggagacctggggcaccagcttgccatgtgtcagttgagttcctggggcagaccctcaaaggaagggcggccagctgagtgggggcttctgggcgcagggcagtccttagactctgttccttcctggggcaggcggcgcacagcactctctgtcatgctgctttaatttgcacttctttgatgactagtaagatgaagtaatttttggccacgtgtttatgaactgtatttcctcttttgtaaattaccagttcctgccttttctcatccatttataggcatcttcaccatgttccttctttgtaagagcttattacgtaatggatacatgacactctggcatattttctgcaaacgacaagggcattaaaattccaggtacagctcttcaggctgtattcatgagcagtcgtgggccacgggattcgtgggcagaggaagggcaccagctctgtgttccttgtgcacatgaagcaggagggctcataggcctgcatgctgtggacttagctgagcggcacagctacatcaagggcaccttgaaggacatgcccctgctgagatggtctccaggatccacaccagtttaagcagcagacagagctgtccatcaccaccaagggcctccacacgggccaatttctgtttgtgtactgtagcaagagggcccagctggacgtcggcagcgtcctccctgcaggcaccacacctgtaccatcaagcgctgcctggaggagaggctgagactggaacttgttagcctgggcctttgagaactacaccgcagtcacctcccctagcccggaaaccaggaagacttacatgaagctgccctccaagaggatcatctcagccaacagagctgtggtcaatgtgggagccagaggtggccgaactgaccagccatcctgaaggcaggccatgcccactacatataaggcaaagaagagctgctgaccatggtgcagagtatggccgcaagccccaaggaacgtcccttcagagatggcaaccactggcacgttggcgaacctgccactgcagagatgtctctgctggtagcaaagtgggtctcattgctgcccactggacttggttcagaattggggctgatgggcccaacaaagtttgtccttctgccaaaaaaatagtaattccaggtacaaatggacgtgctcacttcctatgtatatgtgtggctggcccacaacactgacactcaggaagcactgggctgagcatctctgcagcccggagctgcctccagccccaggcccagcagtgcagcacccctgacgcaggacagcccatctccatgtgtggccagtgctaggaacagccgtgcagggcagccctcctctgatcacaatgagagccccaccagctgctgtcaatggcccaggagatggagggcagccaccatgcttgtccagccagcctggccccaaggagggaccagagaaggctgaagcccaaaaaccacccacacagtcaccatgggtcactcccatctattctgatggacacagggacacggggacggccagccgcatgcagtatcatgcgcctctctcatccatgatgggaagaacaggcatgccctctgatttcacgcccgcctgggacacattttcccaagagaagagcaaggaggcagcgccccaggtgagaggtaagtgccagcaggagtacagcagggtgagccagtggctgtgatccagacagaggcagccagggccaagcactgcgcctgaggacgagggtgtgggagtgggaggctccagggccggtgggcgatgcgaggcgggcacggcttcacacacaggccctgtgggccacctggcgactgtctcatgaggcatgtggcccccagagccagccaccctcacggggcctggcctgccacttgccccagtgaggcaccttggaccaggcacagaggagcgtatgcctttggaactggacttagattcttgaagcttattattttaaaatatttatcttctttttttttttttttctggaatcgcaccttctcaatgagccccgggcccctacccgcagctatgagcccaccagggggaaggggacgcacctgccctgctggcctcaggtcccatcgagacgccatgttagttgaataaatgagtgagcccctgggcctcaatgggacctgattggccacttgctgtgactgccagcagccaccagggacccctaggccgttccagggatgtctcatacccagggcggctccttggggggtgggggtgagcttcccctcaggcagcataagggcctttcctactcaagctgcctatgtgcattatgatgtgtaagaccccacagtcagccttggagtacggcgcagcccccagctcaggcccagaggacccccaggaaggagcgtgctctgtggcgagtggtcattattgctttaacagttattattagaccgggtgcagtggctcacgcctgtaatcccaacactttgggaggctgaggcgggcggatcatgacgtcaggagttcgagaccagcctggctaacacagtgaaaccctgtctctactaaaaatacaaaaattagctgggcgcggtggcgggtgcctgtaatcccagctacttggaaggctgaggcaggagaatcgcttgaattcgggaggtggaggttgcggtgagccagatcgcgctcctgcactccaacctgggcaacagagctagacaccgtctcaaaaacaaacaaaaaacaattattattattattattattattaattatttgaaaagaggtttcactctgttgctcaggctggtcttgaactcctgggctcaaatgatcctcccaccttggcattccaaagtgttgggattacaggcatgagccacctcacccggccctttaacaattgttaacataattgcaattgtaacaggttggctgccccagggcacctgcagacattagagggtgcatggtaatatgcataaatggtgctgacctatctctagaagacttttcaccatgttgttcttttttttttaattggtttccactcagttctaatcattaagtactgaatttgtcatggtaacaagacccagttggacaaccatgtatgcaggtgccggctggcctgtcagatagctgtgggctctggacataagtgtgaactagccctcaagccaagcgtggggcaccaggctggtgggtaagcacagggcgctgcctcctgctactctggcctggcctctgtgaggtgttagcaccaccatgagctagggctgagccaacagtgctgtctcaggagcagcagcgcacgcccggggccacgtggtgtggaggggaaggccgcagccaccgctcataggaagagctccatgaatgttcatcttggccccacttcaaaaaatatcaaactcacaatggaggcagatttgggtctctcttgatgtcattaattacaaactaaatttgcactaaaataaaaaggtgttagactatcaaagaggggcctccgatccgtgtcacctgctcagggatggccactccaccctgagagcatggaggcatgtggatgccagggtcactgctgggcccatccccaccgggaagagcatagccacaaacttggtttcacgcagctgcagcaaggcgcatccctgagagcagtcctgatgggcccaccgcagccccctcgcccgggcagcatccacacccaccgcggcccctaagccccagctgcacccacaccagcacagagggcatccaggaggagccgccccttccctctcaccaggcttaggatgctcccacccatccccagcttggttcttgctttctgccctttcctgctgcctggcactcaacagagggacaatccgcagggacttgtgtagctgagtctgcggtgtacgggagccatcagccgagcacagctgagcaaagacagttgcctgccgtgtacatgccagcaaacagtgcctgggtggagagaggagcccagggctgcagcccaccctggcaacagctcccctcctgggcaccgccagcccccatcatcatctcctgggcaccccagtctctctggctgtggtccaggcacacgtgccacgtgggggagactatacaggggcaggctgtgggggtggcctctgtgtggtgccaagaggaagccgggaagccaagctcccatgctccatgcatgttgtgtttcaggctctgatgctggtttacacacaggtggacatctctgagttatctaagataaagcccaaagaggaaatagcttcagtggctggggtaagatccagacggattccttccctgggtctcgtctcacctgccatatcacaaggccccaggcagacctgtggccaccctccctggcactcaggcacaacagctgcctggctgtgggacccccaggtttagcgagtcccctcctgtgtctgctggctcttctggccatgggcaggactcctgtggtgcagggagggatacgccagagccttcagcatctcaccctcaagagagggacagagaaccatccagaggggctggggacgccaaaggggcacatgaagatctcaacttccagtttttcagggctgcagtccagaggcagtctgtcccttctttaaaaccaaatctaaacttaactgcacttagaagcccctgcactgggaggcgtttgctcaggatgccccagcctggccctgctcccctagacagccagggattcaggccacaactggttaactcagcgggcgaattcgagcccgcagcagtgctggctgactgtcttcactcagcgctgtaatcggcacatctgcagacaggaaatcctcctcactgaagttcccagtctattatctgagacacctggtgtgggcgggtgattcagagacaaacaatgagcgggggccccctgcacagcaattaactgctttaactgctaatatgtttaatccaccacgtggagatcaaggctgcgtcgaggaaggggctctggtcctcctctgcttccagactgcagggcccacttcgcaatgccaatgtccatggtcctcgccagctgcggccaggcgccaggcacacgggcaacgggcagggccagcactcggccccacacgggagctctgtgcagcacctgggccccttctgtgtgtgtgtgcaccgggcacggaggcatccccccttcctgtcggagcccagcttgtgcggacgtagtgcacacccggtacaggaagcagagtcggagatgttggcattgccagctgtgccgcccctagggcgctttattttaacctcccagagtggatcatcctttattgcaagtagaaataaagcttggttaaaggcttatcgtacaaaccagcagaaaacgctcgcagttgctgacctgggaagtggctcctgaatgtttacaaaacctggctctgagcagcagcgaagtcagcacatgcccgagcggcccccagcaggcgcgcagaagccgcgccgccctcgggaagcagggtcagaggccaaggactgtgaaaagcttccacccccagcatcaatcatgccaggcagactgtctgggggatgctcattttgaaagtacaaaaaaataaaacagactcctagcaagggaggatgggcgtgcaggccacggcagctctgctgagtagggaggggcctcgcttgttgcctgccaggctgacgccccggctttccggggacacagcccccggcccattggtctgctacatccctatgggcttggtcgagggctgcccctcggttcaatggcaacagctcccttatgctgtgggtgaacggaggtgtcagcagacagaggaggagggctagggcgcggtgggagggagaaactcgccacctcccctttagagtggagtttatttgggaatgacagtaggaggataaattttgaaagaaaaataaagtggagtttaggatgagaaccatcagtacactccagagtccaaaatgttacctaatccttcgtagtgtttatcataataaacttacttaaaatctacttttacaacgtggctgagaacattgctcttgctgactgatcacctccgggccaagagccctgcgtgcgctcaggcatctcaggtcctccccggtcatcacctctgcgcttgtgtccactgcacaaaagtgaagcctcagccgctccaggctggtttcctttctgatttcccattccgagtgactgcttcagaagtgcatcaccctatgacacagcttgtgcctctgggagccctcccccaggagacactgacccctggccagccccacgcaagcccggttagctgatggaggtggaggcaggtgatctgagagggaccctggctctgatcttgggctctcgcaggggacaacggaccaggctcagcacagaaaggcctcggagaactaacaacactgactaggttgctcccgccttcaacatgcaagttgacagggtgattgggaaaactaggagcctaaactagacggccaggcaccgaggtgggtaggacatctgagcaggcatgctgtgtgtgccgccacccaccctgacgaggacccgcagccctccttgcggcggcccatctgcaatggcctcctctgcagcaggcctgggacagagcagtgtctgggcgatccctgttggctccagctgccccttgccagtcccgtcagacagccccggcccaggcctgggcacaggtatcccctggctgtgtccacactccccacacctgctcggccactgccccatgcaaaaccggacctacacctgacagagagcaagaaggtgagaccagactgtgcccagcaagttgtagccagcccacgcctggccgggaaacgcccaggcctctgcccagcactggaagggtgatgtctttggaagccttcgaaatgtgacttctggaaaggcctgcaaaatgccactcctggcatgtgatgacctgccaggcccaaagggacccactgggaaacactgaaagccacgagaaggctggacagaactttaaaaactctgtgtcatttttatgtgctgaaaacaggcggcttgtgcacacccatgttcacagcagcatgatccacaacagccaaaagacggaagcaacctaagtgtccactgacagataatggacacacatacaactcagccttcaacaggaaggaaatgctggcacatgctacacaaatgctaactctaacaaatgctgcaacatggatgcaccctgaaaacattgtgctaagagaaatgagccagtcacaaaaggacaaacactgcatgattctacttacatgaagtccctcgaggagtcagatccatagagacacacagtgaagggtgagtgcccgggcagcagggagtgagtgtttaatggggacagagctcagtttggagataatggaaaagttctagagatggatggtcatgctgcttgtacaatatgaacgtacttaacaccactgaactatatactttaaaatgcttaagatgatgaatttgatgttatgtgtatgtcaccataatttttaaaactttcaaatccatatcatttttatgttaaaaacaacaaactagcttggctgggcacagtagctcaaacctgtaatcccagcacttagaaggctgagatgggaagattgattgagcctgggaggtggaggctgcagtgagctatgatcacaccaccacactcctcctaggcaacagagagagaccctgtttcacacgcaaaaaaagaaaaaaacctagctggaaagcctgaagcagcaaaacatttaatatgctaaagaaaaaatacatactggccaggtgcggtggctcacacctgtaatctcagtactttgggaggccaaggcaggtggatcacaaggtcaggagattgagaccatcctggcctacatggtgaaaccccgtctctactaaaaatacaaaaattagtcaggtgtagtggtgggcgcctgtagccccagctacccaggaggctgaggcaggagaatcgcttgaacccgggaggcggaggttgccactgcactccagcctgggcgacagagcgagactccatctcaaaaaaaaaaaaaaaaagaaaagaaacataccaagacttaaacctggaaggtgacaagtaggatttatgtgctgaaaccttaataagcaattgctcaagggccagggaaggcgaggatgattgcctagttgatcctcgatgaggacacctggctgatgccgtctcagtctcttctctggttttttccagcatgtcccacggtggtggggagacacgcagagatgcaaggtgctggggatggcaagatgggcacagcctagtgtgagtgccgccccacaggccttcacggttgctctcgaggtgcactggggagcggccaacccgcctggcagccagcaggatgggggagccctgggaggtgacaggaagtggggcaaagattctccatgcacctcggggagaccagagacagagcgtgtggctcgacgtgcccttacctatggcccacaggacggtgtcaaaggtgcccgtgtcctccttgccggtggtgctgtcctcccaggtgacctgcagctggccatcagggagcctcctgacccgcgagggggcacagcccctcaggaaccgggtgccatgagatgccatgtgctctatgaccatggaggacatttgctgcaaagcacaagaagacaggccatgaagaccaggtggccgtgggagagaggctctggccctgccctgctctcgaaggcctcaatgaagggcggagaggggtctgtgcggaagacggggtgagacaccctgccccctgctctacgtcctcttgctctctgtggagtgtctagcccctgtcctggctccaagtcctcaaccctgggccctatggtcaggattcactcagcctgtgggctcctctctagatgctaattaactaagtcttcatcagccagatacggtcacacctgtaatcccaaccttttgggaggctgaagtgggagaatccctcaagcccaggagtttgaggctgcaatgaactgtgatcacaccactgcactccagcctgggcgacagagtgagactctatctctaaaagaaaaaataagcaaggccgggtgcgatggctcacacctgtgatcccagcactttgagaagctgaggcgggcggatcacgaggtcaggagatagagatcatcctggctaacacggtgaaacactgtctctactaaaaaacacaaaaaattagccaggcgtggtggcaggtacctgtagttccagctaactgggaggctgaggcaggagaatggcgtgaacccgggaggtggagcttgcagtgagccgagattgtgccactgcactccagcctgggtgacagagtgagactctgtctcaaaccaaaaaaaaagaaagaaaaaaaagaaaaacaaccaaatcctggtacatctacacatttctttaaaaaacaaaaacaaaaaacttagtcttcactaaaaccaatggcagagaagcgtgccttcccccaggagctgtgccctggtccaacaagatggcccctgctcctggcccacccctccacatgtggccaacatgcccctctgccatccaggagccaggagggtaggtaggagactctgctcccgcctagaaatgtaggcacagcaggctcaggtccagatcagggacagagagagtcctgcttctccctcccggcccaggaggcctgtgcgccccaagtccagctacagatgggggccctgttcccaggacaatggggacttgcacggaccagcagtgaagctggccacagcttctggtttcaagaggagaaaaacagtcactgctaacatcctctgacacctgtgcgggtgtgccagctggctctagatggcgtgtgtgggagtctggcccgccgggcagggctggctgtgctgcagaggggctgccgcacaggctgttcatcactcctgcacccctccagaggcctggagggcatggccatcccaggctctgagggagaaccatggagcctgtccaggacacagggtccctcgcccctcagcctggctgcctagactgtgcatcctccttgcctgggcacggcccccattctgcaggcccctttcctcctccgtccactgccagctcaccctccccacatctgaaggctctgaggccttcctagacactgcgtccctaccacagggctcggtgggtttgcactgagggacatgatgggagtgtgccatagctttaggatggaacaacacatggccacacgggtggagggacacgtctctgagtcagcctgggggtggcactgggagtctggagatgacaggcctggctcctcccacctcaggtgacctcctcaggctctgtgagctgagggtcggccgaggacctgtagcagggcctgcagatctgcacagctcaccctgcaaggggcctccttcgtggcagtcatggagtgtttgacatctccacaatgacaactccagacttctattttaacaggagactttcccttgaagagtttttagctaaaaaaagaaaatctctattgctccaatctaggagctcgtcctgctggccacatgagtgtgtgtaccccagacacagatgaaggccactgtacacagcgcacctgtccagaagccaagatcccacgggctgtctcggagccagcgctgccctgtgtccctcaccccagctcacacattacagcttatttcacccccactccctcagaggggacaggcaaggggagagcagggagttgggggtctctgaggtggggctaacacttctgcagcacacaccggcctcttactaatgggacgacccggagggtgacctgctctgccggcacaaggctgggctgagcctcccttcactgtgcctgtggtcggctggaggcctctgtgcagctgtgcgccccactgccaccctcctccctcgctccggccgagtgtctgcatatttcctggacaacctcctcatccaattcaagggttatctctaaagattcaggcatcactcgtggcccatgactgcactgcacctgcctgggagggggctgtgggaggaaggcctcagagccacaggggcgggagctggggcctccagcactacctggtcgaagccgcggagggggatgctgcgcatcatgatggtggtgtccagcccaatcccggtgaggaagccagcacactccagggccacatctgtggggtgccagctaaggagcactgtagatcccaattttggaaatgatgggacaacaccccagggccctgtgccacagcccacaccccacccatccatggctggccctggaggaggctcccaactcaagacccccacctccacatctcaagtgcacaggctggggttagcaaggagccgccaagcagcacccacggactaggccggcctctggcctctgctcccatgtgctgtccatcccggctccagggcgaggcctgcatcctggtggattccagttgggatggagaggagtggctggttcagggaggacctcagccacgggagatgccaggcagctgctttcttccacctgtgctctcagccagcggcttggggcttttttttttttttttttttttgagatggagtctcattctgttgcctaggctggagtgcagtggcatgatctcagctcacagcaacgtctgcctcccaggttcaagcggttcccctgcctcagcctcccaagtagctgggactacaggcatgagccaccgcgcccggccagggactttcatctccctcagatgtccccttgaccccaggccctcctgcagctcctctcctgaccctccctgtctaattgtcccttctgaagcaatgggtccaggctggggctgctcttgagggaggacagcccagctgcctcatggccatgtccagctgtcccagctcaggaagagcctccaggaatccctggccagaggtcagcctcaaactgtccccaggcacagtagatcctccacgccgagaggcccagtaagtgccgatctgaggcagcaaagagcctgccggaagggcgggtggcagggagggactcaagggaaggagtgtccagttcccaggacggccacctgcacgcttgcaaaggatacagctggccccgaccaccaacctgttagagaaacagagagagagcacatgtaaagctgaggcccttattgaccaagtgcagtcagagcagaaccccgcagcctttgcccaggcccttggtcagctcgtgggctccaaggttactgttcaaacagcttgccccaggggacaaagcccactttccaaggctacactgtcaagcatgttgtgaatcagcaaatcgcctggtggtgaagggcgtgtgtgtcagtgacaagtggtacctgtcccctggaaggcacccggaggcatggagaaacatccaccagagcagcacatggctttccttctctccccccggggcctcctgggctagggtggaagctgggagatgcttggcaggatggggaggccaccagaccgcaagggaagacatcatctgagcaaagcactctcaagaccacagaaggctgggcccttccatgtgccagaggcacatccaaccctatcacagctaggcgcagggccaggagggccagctccccagagaggggactgaaggaccccagggacaagggaggcagcacaggacactgcgaccagcagtcattggaaatatttgctcttgtagtgaaaaccctctattgttcaaccccacactccacatgtgttttgcatgcacatgtactcacgcacacttgtatgtgcacacatgccacacacctgcatgcacatactcttacacgggcacaaatgtacacacacacgcacatactcgcatgggtacattcattcatatatacatatgcacacactcatgtagacacatgcatgcacacacatgcaaacgggcacagaacctaacacgaacaagaactcccagcggggcagctgcacgtgggtgggctcccacattacccttcagtctttgaacaagaggaggtgatgtaaggacggataagcccaatgtcattgctaatcccagcaggtactaatgatataattccatttcaaaacacggtgtatcccttggaatcattctgcaggtgccctgcgggaagcatctggcatgcagcttcctcactgtggctggggacagaaccgcaccactgtcaggattagggtgagcagacagagctctgttggccggctgagcacaaggtggttacatgcctcactcagcatgtgaggacagcgaagggggaccctgggacccccagccaagcaggattgcagagatgcattcccagccccgctcagggccggcaacacttgggaaacaggcaccacggtatgcacgcacttccacacatgcacacacacataggcaccacatacacatctctacacggaagtgcacttccaaaatggcgaaaccaaactctttttggacttgctatatgcagtgaaaggtacaagcttttgtttaagatatgaagttatggccaggtgcggtggctcacgcctgtaatcccagcactttgggaggccgaagcaggcagatcacgaggtcaggagatcgagaccatcctggctaacatggtgaaaccccatctctactaaaaatacaaaaaattagctgagcatggcgatgtgcgcctgtagtcccagctgctggggaggccgagacaggagaatggtgtaaacccaggaggtggagcttgcagtgagccaagatcgtgtcactgcactccagcctgggcaacagagcaagactccatcacaaaaaaaaaaaaaagatatgaagttatgagttactgcaaatataaacagaactctgctgctttgcatatcctgccctaaatgcaagggtgtaactgggcgagagcccattgtgtggtgccctttgccccctgctcccagaggtggctgtgcatgggctagatgcttcctgctgggctgtgcaggcactggcagagtgaggccaatgcatcccctctgtgggcagctgggcccctgcacgtcagggccttcctggccctgaaggccaacccttctccaggaatgggccctgcagctgcaggatgggggccaggctgctctccgggcctcctagctcattgctagggatacagcaacacaccctcctgattttgccacaaatgtttgctgtctctgccaccgacgtgtacatccccacctcctacacgatgctgacccaccaggcctggattggagcgggggcaggtgactctccaggccctccctcggagtcccccagtgcccgggcctcctgtcctggcacccacggggcacaggagaagctcccgcctcaagggccaccttcaaagtcacaggtgcccccatccctcagctgccagctctgaatcagcaactgagggtacagctaggaggaggtgggtgcagtgggcatattcccgagtgggcatccttgaccctatgtgttcggctgaaatctctcaacaaaagctcacgtctcgctcgtgtggagggtcattttgggcctcttcttgttgtcatgagcaaggattattgacagcattggttttcactgtacgcctccccgcattgatcaaattatgtgaatgtttaccctttgaagaatgcaggatacgagaattccaacagagaactccgttcagaccagctaaagtaaaaaaatgcccgagcaaaataagacagacaccaaagcctccagatcacagggatagagagtacccaaagacagggacctacagacaccttcttcaggccattcacggcccagcaggggtagggacagacaggaacgtggtgcagcaaccaactcaagccatgactggccacaggaagtcagaggtgctggccacagaagtcaggggaccagctcacaggacctgggggtagggggctggaaccactcaacttaccgctgcattaaaagacccagaggttgggtgcggtgggtcatgtgtgcaatcccagcactctgggaggccaaggtggacagactgcttgagcccgggagttcaagaccagcctgagcaatacagcttgtccccatctctacaaactaaaaaaattactggggcatggtggtatgcacctgtagtcccggctactcgggaggctgaggaaggaggatcacttgagcctaggagtttgaggctgcagtaagctgcactccagcccgggaaacagagtgagaccctgtctctaaaacaaacaaaacaaaacaaataaaaatcagttttccatgtgatcccagcagctcagctctctgtgctttttggtgtgcaaacattttccaaagaggcataataactactgcaggatgagcctaatcacagggcaggctttcttgttcaaaattggaatggggggaggaagcagaaacaaaagcattaattcaggcccacgaagcctaggcttaaagagcaatccatctgcctcttgagcttgaaggcctgctctccagagggaatactcacacaaagtgagtctcatgggaggcacctggccccttggaggtcctgccagcccaggaaataccagatgggccgccaagctgcagatgccccagggaggcagcacagggctgggggtgctacgaaggcctccttccccggcttggctggaaccccgccgccccacccaacccctcaggggcagatgctgggccggagcctctgtgtgctggccctgtaacaaatgccactgaaagccctaccttgtcatgtcttagccacagggacgcacacagagaggtggcgggggctttgcagtctggtaacaagccccaggaggacagctggtctccctattgctgaacacaaggacatcccatcacaccagcggaatgtgccacttaaattaaattttctcccaaatggctgtggttcttcccaagataaaatttatcttcttccctcttgtgcttaggaagagagaaaaatgatcgcagtacctggctggcttccggacttcctaagggtcaaataaaagctctttccatgacacactgacaggcagccttaaaccagcccaagttataaaaacactctgcctcttggagccccaggagtgcgaggacagacagcagcaggctggtggagcagcctcagagggtggacaggcctggctggctgcagcccctcccccagggcccagtgtgtgggctggtcagcccctgagccagcctggcagctgcaggagaggctggccccatgctctgtaaacccccacggggacctgggcaggggctacagagctggcagcaggaacaggcagaccctggttgtttccgggaagcagtacctccgttatcggacctgagaggaggctgcggtctcattcacgccctcggccccatcccagtgttgccagctcagagccctgctttgcagaaagcggacctacagacacagcaagagggaggactagaatagagggaccacaattccctatattggggttagggcacctgagctccaaaacctggcactgagggagaagacgaagcccagggccgtgggtgtgcaagaggcagagacaaggcacactggcggggcccaagtccctgccgggtgcggaggcttcccggtggaggcagccctccaggtcaggaagtggcaggaagattgtgcggctgtgggactggagttggagctcagctccttggccccccttaattgccaggcccctctgggcctcgggctcctcttggctgcacttggatcccgacccccagtgcctgcctctgtaaaggagctccccggtgtgggctcaccatcctcgccttccacattcctccacctgccgggggcttgctctgtggaatggaaggtttggtttgcaaggctgcatgccccctctgagcctagtcatttggggtcacgtgcccctccgcacccctgcctccctgcagtggccattgttcccagaggggctccactgcctgcccagggtcactgtacctccccagaaacctcctctcttcttcaacctgtcttgcagttccagagaaggaaagacacaacacagcagaaaaggcaaacgggctggcacaaggcgggcatctgcatggcagaggcggagcaggagccgacctggagtccttcccagggtccccaccaagactgggaggacagtcccttgcgccagggcgtggctatgggagtggggcagccagaacgtcccccgccccaccccagtgcactcaagggtcctgctcacccacccacaagctcacactgctttttcaggagttttctgagttttctgcacgtcttcctcaccctcctaggttacaaaccaggtgctcagcccactctggtcaacaggtatggccccattttgccagcatatggctgtttagtgaagtgcactgtttaattctgtctccccttgactgagcttggacacgatccccctgcctctgccatctgtccagccctgggctccctaagacctggatgcaaacaaaggaggaagggggctcccaacttggggcccgaggtgcactgtgatgcctgagtggcctctctggggcaaaagtggcatggtacgaccttgcaggctgggtcccaggccccactgtgggcaccactcgccagatctggagctcccggcagtgggccccacacagacgtgcgctgaaaggagttcctggtggcagcctgtgcctgtagtagagagggacgagggaggcctcgtgcacgccgcagagcccaccgagggcctggggccagggggacagggagcctccttggtggaggagccaaccaggggacagagtgcccactgcaggaggggcactgtgatgccaggcaccgtgagttgcgcacctggcctccaggatgggaccaggtagaaatgtcccacccgactacgggaggcactcaggggccaggggagcagccccggggtccatattaatttcagctccattttaaaggcgagttaaaataaacatggggaatatttataaggcaaataaatctggcagaaacagcccctccaagtgtgagtggaggcctcccctcagccccagcccaagctgataaaatacagaaatgctactgtagaccctccgggcttattttgactgcagcagaggaatgtaacatgtaaacactgactcccatattacactgttacaacttgcattaacagcgccggacaaaagccgcattttcacagaagcatcgtacagggatatatctccagcttaatttttaaaaaaaccatttcctcacataaatcatgctcagaatgaaacgggtgactgatacattgcaaacactttttttcttaaacaataacatacctagattccttctaaacgaaagagctttaaaaaaaatcttctaaatgttttttttctgaagaaaataaacactgcagtttcttttctgaacaaaatatctggagctgtgtcttcccggccgagccagctgcccccagcacagggttgcagaggagcgctccccaagccccagccaccttgctagggagacagcaaggccagggcacccagagcaccgggccccctccccaggcccaagcgggcagcctctgaggggaacaggcacaacgagggtggtgaaagtgctgggctgcagtgaccgtcaccgaagaccccagtacatcgaggggcccagcagacatcctggggctgccagacatccaaggccatttccctgaaggtccagcagacaaagcatcctgcaggggctggaggggcatccagactccacccagagaagcctacgtgaaagacaaccagaggcacaggcagaactcaggacgccgagtgagaacagtgcctcgagatgggcactggggcccgggcaacccatctccaccacaccgcagaagaagtgcagccagcccaaggaagtaaaagaaaatccgacttgtggacgcccataaggaaaatacagggcttaaaaaaaaaaaaaaaaaatcttgggggtggggcaggcctttctgaacatgcaataaatcaaaaagccactaagtgtaaaagatttaagttacattaaaaaaaacttaaaccatttgtacatcacacaagttaaaagacactagaagctgagaaaatctgcaccacaagcgacagaggatcacatccctaatacacaaaccagctggagggtaagaagagataagagaagagaaaagccagacgtgaaagtggacaaggaccatgctggcgatttgtgcagcacacatgggcatgctcacagacacgctcatctcaaatgaggctgtgacacgaggcttttcaggtaaatgtgtgaaaagaccactgatcacagcaaatgcaaacagagtcagatcatgtgtaactcagcagatagtcaaagattaaaaaaacagtctgggtgccgtagctcacacctgtaatcccagcactttgaggggccagggtgatcacttgagcccaggagttcaagactagcctgggccacatagcgagtccttgccctaaaaaaaataatcattagctgggcgtggtggcgagcgcctgtaatcccagctactcaggaggctgaggcaggagaattgcttgaatccaggagatcaaggctgcagcgagccatgatcgcaccactgcactccagcctgggcgacagagcaagaccctgtctcaaagataaaaaaacagataacccagaaattatggcataacaggaaaaagtgattggtgtgacaacagaaaaacttaaaatttctgcatgaaatactatcaccaagtccaaagacaaaccacgatcagtgggtccaatggaaggcagcaggcagtcgatggaaaccagcacaagctcagcacagtctcaggagagtgtgggcgccgtgggtagcagtgaccactctcaggagagtgtgggcgccgtgggtagcagtgaccgctctcaggagggtgtgggcgccgtggatagcagtgacggctctcaggagagtgtgggcaccgtaagtagcagtgaccgctctcaggagagtgtgggcaccgtgggtagcagtgaccgctctcaggagagtgtgggcgcaccgtaagtagcagtgaccgctctcaggagagtgtgggcgccgtggatagcagtgacggctctcaggagagtgtgggcgccatgggtagcagtgacggctctcaggagagtgtgggcaccatgggtagcactgaccgctctcaggagagtgtgggcgcaccatgagtagcagtgaccgctctcaggagagtgtgggcgccgtgagtagcagtgaccgctctcaggagagtgtgggcgccgtgggtagcagtgaccgctctcaggagggtgtgggcgccgtggatagcagtgaccgctctcaggagagtgtgggcaccgtaagtagcagtgaccgctctcaggagagtgtgggcaccgtgggtagcagtgaccgctctcaggagagtgtgggcgcaccgtaagtagcagtgaccgctctcaggagagtgtgggcgctgtgagtagcagtgaccgctctcaggagagtgtgggtgcaccgtgggtagcagtgaccgctctcaggagagtgtgggcgccgtgggtagcagtgaccgctctcaggagagtgtgggcgccgtgggtagcagtgaccgctctcaggagtgtgggcgccgtggatagcagtgaccgctctcaggagagtgtgggcgcaccatgagtagcagtgaccgctctcaggagagtgtgggcgccgtgggtagcagtgaccgctctcaggagagtgtgggcgcaccatgggtagcagcgaccgctctcaggagagtgtgggcgccgtgggtagcagtgaccgctctcaggagagtgtgggcaccgtgggtagcagtgaccgctctcaggagagtgtgggcgccatgggtagcagtgaccgctctcaggagagtgtgggcgccgtgggtagcagtgaccgctctcaggagagtgtgggcacaccatgggtagcagtgacagctctcaggagagtgtgggcgccgtgggtagcagtgacagctctcaggagagtgtgggcgccgtggggagcagtgaccgttctcaggagagtgtgggcgccgtgggtagcagtgaccgctctcaggagagtgtgggcgccgtgggtagcagtgactgctctcaggagagtgtgggtgcaccgtgggtagcagtgaccgctctcaggagagtgtgggcgccgtgggtagcagtgactgctctcaggagagtgtgggcgccatgggtagcagtgaccactgcccaggccaggggtatgggaggagaggctcctttctgttttgtgtcttatcaaaaagctgatgcctgagttaccaaggacagggaagcaggcagagtacacatggaattggcctgtcagcacaaagtgttaagacggaagggcagctccccttgtaaagcgtataagaccacctcacagccactaggatggccactgtcaaaaaaacagaaaacatcaagaaaacagtttaaaggaaaaaataaaaattaaagaaagaaaaacagaaaacaacatgcactggcgaggatgtggggagcccagagtcctcctgaactgctggtgagaatgtaagatggtgtgggcgctgttgggaacaggatggaggttcctcaagaccataagatccagcaatcccacttctgggtttgcatccaaaagaactgaaaggtcttcaagaggtatttgcacacctatgttcacggcagcactgctcacaacagccaagaagcagaggcaacttgggtgtccactgacagatgaatggataaacaaaatgtggtgtgcctgtacaatggaatattactcagtcttaaaaagaaggaaatgcagatacaacatggatgaaaagagttccagacatggatagtggtgatggtttcacgacattattaatacatttaataccattgaactgtatacttaaaaatggttaacgtgggctgggcgtggtggctcacccctgtaatcccagcactttggaaggccaaggcaggtggatcacctgaggtcaggagtttgagaccagcctggccaacatggtgaaaccccatctccactaaaaacacaaaaaattagcggggtgtggtggcagacacctgtagtcccggctactcagagggctgagacaggagaatcgcttgaacccgggaggcagaggttgcagtgagccgagatcgcaccactgcactccagcctgggcaacagagtgagactctgtttcaaaaaaaaaaaaaaaaaaggttaaagtggtaaattttatactatgtctgttttatcacaatgaataattgggaaaatgtgtcagaagcacttctgatggtaaacagatgcacctccaaggttttcactgcagcattgataatgatgaagaagagaaactactgagatgctcattaacaagagaaaggtcaaaggaactataccacatccattcaagggaatccagtcctgaccccacacaaagatgccccgtgaagtgtgaaacaatgacaagcagagcatgtgacacaccactcacacacacacacaccactcacacacacacaccacacacacacataaccactcacacactactcacatacacacaccacacacacacaccacacacaccactcacacacacacaccacacacaccactcacacaccactcacatacacacaccattcacacacacaccactcacacacactactcacacacactgctcacacacaccacacacaccacgcacacacaccactcacacacacaccacacacacccacacccttcacacacacacaccacacacaccacacacacaccactcacacacaccactcacacacacaccacacaccacacacacccacacccttcacacacacaccacacacacaccactcacacacaccactcacacacacacacaccacacacccacacccttcacacacacacaccactcacacaccacacacacacaccactcacacacacaccacacacaccattcacacacacacaccacacacatctgcacgcacaccatgcacattcgggcacacacagaagtgggacccttttccactgatattttctcctggggaaggctcgagactgctattgaccaagcctctgccgccctctggtggtctctctgctccctgccaacatgaagtctccacaccccacaggcaggagctgcctggacctgggacctcgggatggcccactctgtgggcatcggaatgcacttagtgactctgcacctgctcccatggggagtgagagccacttgcacgctgctagcctcccttccacaatcaagatgttgtttctgaggcctttggagtctttgctagatttcagggaaacccaatgtacaaatcagaagacagtgagggtgttagatgagggctgggatagggattgctggctctcccctccttaatgttctccctgatgtccttgaggggacccactggaaccccagggctcctgggaaccccatttgacaaccactgacctagataacaaacagctgactccatttatatggcagtcctgttattgttattacctccaaggcagccacaggacagagtaaatcaacagccctgcagaggggcacaagtcacaggtttattgtttagttttgagacaaggtctcactctcccaggctgagcgcagtggtgcaatcacagctcactgcagcctcaacctcctgggctcaagcaatcctcccacctaaagcctcccaagtagctgggactacaggtgcacagtactatgctcggttaatattttcagatttttgtaggctgggtgtggtggctcacgcttgtaatcccagcactttaggaggacgaggtgggcggatcacctgaggtcaggagttcaagaccagcctgaccaagatggtgaaaccccatttctactaaaaatacaaaaattagccagatgtggtggtgggcgcctgtaatttcagctactttggaggctgaagcaggagaatcacttgaacctgggaggcagggattgcagtgagccaagattgggccattgcaattcagtttgggggacagagtgagaattcacctaaaaaaaaaagccaaaaaaaaaaccaaaacagatttttgtagagtagaggtctcactatattgcccaggctgatgctgatctcgaactcctggcctcaagcaatcctcccgctcagtctcccaaagtgctaggctaacaagcatgagccaccacacctggccacaaataacaggccttttttccttcttttgggtaaaccggaaagaaagccccaggagcccagcaccagcacaggctctaagggtccagtgctcactctggtgaacaaaaagaggaccccaccaagcacgcgcaggccttacgtttttccaggggattccttcagccagaagatgtcatcacttgtgattccatattccaaggcaccttcgatctgtcaagacagaaatgaccccttggacaagagctccatttggcctgtcctagggcttccttaaagaggatgccagctttgcagaatcaagcagagctttcccagggcacacatgcacagggcttccctgctgccagtccttgtctgcaggctgtggcctctttggggctgcaggtggcctgtctgcatctaagctgctgcactccaggtcccggtgccctcgcagggtacctttcccctctgttccccaggaccctccccttgaccctggttcagagcaggatacagggcctgaggtgggtacagcaactgcaggggccatacaggcagacagctgggacccctcaagtctgcccgggttctggacagacacatcaaacagacaggggcatgcagccccagggagcaacacctgggttctgggggatccaaactcagagagaggaagtggggagagaacaggtcagcaaatcagggccagcagagctcaggtgtgtctgcgcggcaggggtggcctacaaggccagccagaggagaggaggcacagggggtaagtgccacaggctgaggtgggcagggactgaggggcagctctgagggcacctggctgaagccaggacggacttcacactctcgagggctggcccgggtgggctctgagcccagaaatcatacaggtcacctgaagaggggcggccaagcaggtgggaggcccagggtgaacgtccccttagcggccatgagaacaagatgtgctggtggaggaagcggatctcaaacagtttatgcttccaactggcaaaaaaaaataaagtcaggaatttctcaggtttactcaaggaaaaccgaaaggtctggcaatcaaagggactaaaacgcaagcaagccttggcagacaccctgggagggcgtggcagggagagcgaagcagccctgagctgcctgcctcctaaggaccaggagcgcctgctggatcccctgtgagcccaaagagccgtcagcagctgcccgtgaggtgcagagcagggccgggccaggccagggcccctgtgcagtgctccctggtgcggatgcacgtgcagctctgcctggggcctcagagaaacccaatgaccgctgggctgctggaagctggctgtggccttctttaagcagaaccaccatgagcccagctgccaggagaggggatcactgggaccctgtctgcagcagctgccttgaacaactgcacagtgtcatcctacaaagtcacgcagccctgagccccacctctgtgcataagcaacctgccccctctagaggctgctgtggctgcctggcggccagacaagtcccacggcctctaaggactgggggtgcttgtgctcctcggggccgctcctttccctgtttccacagtaagcacaggacgaagtggaggctggggtcacatccaagaagtggcagaacctccccttgctctgcctccaccggactgcccctgggtctaagtcagaggtggtgtggcctccaggccgagagagccgtggtcttcaagagcttggctgcagcctacttagaggcttggagcaggcggcacacggttccctgggagacccgtggggactggtctcagccaaacctctctgctcacccccagcccatttgctttccctgctgcagctgccccccaacccctcaccccggggccccttcctcaactctgcccccacaacccacaagactgggccaggagttattcacctctctgttaaaaacagcgataaaactggcaagaactgggagattcagaattatggaaattaaccacaggcttgcagcaacacagggaacatttaaagtcaggaaaaacagctgaagctgagtgagaatgggaactccagggtgttttaactcactctggtcccactcccacctcagcggcagccctgaacagtgatgtgtcagagagagcagaactcagctggggtctttcaaagcccccccacaaagaagagtcagagtcagcaactatagggtcatcttcatccaacttcaccggagctcagccagggctaaaagcctttctctgggggcatttgtctgaggttttcttctcacagctgcctgaggggataggtaacagttagagccaacaacagactgcccaaaaagcttcaaaggaaaagccaaagtatgagatgtctgctggagctttgaaaggttccagcatattcctgggaacctaggccaggcgcatgcacagcactgtgcacacatcaggaaggaccaacgaggccctgaaccctcacctccagctgaccttgatctctgcagaagcaggaagtgaaggctagggcagagctgtctgctgcctgttgagtgtggaaggcatcccctccaaacgcacacagagccctcagcaaagaccgggagagttcttagtttagggaaatctccatgcagttcttagctgaccactaagctaaccaagtaaagacttcagtggccacatacatcaaagaataagagtctacaaagtcagttccgaaaagtcaccaaataagcagctgtaacaacagaatcctggggcagagggagaatctggtttccaaagttatcgcattaaattatttgaaatgttcagctttcaataaaaaaattacaagatacgtgaagaaacaagaaaccatgacccttacaccccactggaaggaatgtaaaacacagtcattgtggaaaacagtctgaggttccttgaaacgttccttgaaagattcaacataaagttaccacatgacccagcagttctgctcctaagtgtaacccaagagaagtgaaaactgaagtccaccaaaaaacttctttgcagatgttcacagcggcactattcataatagctaaaaagtggaaataacacatgtgtttatccaagcaagtagataaacaaagtgtggtctatccatacaatggaatagtatctagccataaaaaggaatgatactgacacacactacaatgtaggtgaacctggaggatgttatgctcagtgaagtaagccagtcactaagggacacacacatacgagtcactaagggacacacacgtaccagttacatgagaaggacttacatgtacgatttcacttacacgaggtgcctagtgttgtcacattcatagagacagaaagtaggtggtggtttctaggggctgggggaggaggcgctggggagtagggtttaatgggaatagtttcagttcagggatgatggaaggagttctggcaatggatggtggtgactgatggccgcacagctctgtgaatgtactaaaaaccactgaattgtaccctaaaaaaggctaaattttatagcgtgtgaattttatttcaaactttttttaaactgggggacgtgaaggaggaagatgaagaatgaggcttatatcctgaatgttccaacattctgaggctgaagggaaaagggggaatcagcaatggagacttaggaagcaggatcctggtgtggaaggggacagatccagcggggcagggggagagcagaacgagagctgtcctgaggatctggcagcgtggaggccactggggaccccacatttcagcagtgtggattcaagagaattggaaagcagaaagtgatgatagtgagtatagggggaaagggtgtgcaagctgctgctgtgggaagcacgtgtgtaaaaacgtatccctcaaagaggccgggaatgggccacggcagcagggacgctatgctctggggacactcacgtgcgtggggtatctcggccgccctccagtagcaatgatgatgtgatcggctgacagcagaatctgaggagaaaaagagaaagccgtgggtcagacaggtgcatggtgatcaccccaccggagggcctgagcaccacagaccttggccagcagttcccacggcccctgccctgtagcgtggacccttggccagcagttcagaggccctatggagctggaatcccatcaaccatcagcctggcaggagggggacaggcagaaagcacagggagatgttctaactccaagcacttcaaggcaccctcaaatccccaaaaaatcctgcaaaaagggtgtggtcaccaaccctgttgccatgccactccgagcagcagggcagcaaattatttgatcacgttaaagacaagtgcccagcctcaaaagaagccacctttttgattccagcagcacgtgttactaagaacagcacccaggccaaacacagctgcagttggtgcccaaggtctgcagaagggtccacaaggagccacgcgagtaagtcagatgctcacctctttcccacctttggcaacgccgcaaaccgtgtgctcgtcaacaaagctggctttgatgttaaagtacttgacttttctgaaagataaagataagattttcaaacacttcctctgcaaattaaacctcaccaactggatcaatagggaacactggtaaaagggagctccagcccccagcagggcctggtgctgtggctcagatggaccaagaggtaagcggcaaccatgctgagaagcatggaggggatgtgggggcacctcgcctgtcccccagggatcccagggacatgttaaccacaggtgtcaaagcagggacggaagccagctcagcacggtcctaagaggccacgtacagccctggtgtgcagcaagaggtggctggacctctcttggggacagtcctcatcacccggacatgttccagcagggagctgtggtgcccaccagatggtgtcaccttctgatttcaggggtgtggtaacaccaagagaacgggcatgacaaggctggcaaaacagtggctgggagcatagtgcacagaaacaaatgacccacgctttcttttcttttttttttttctgagtcaaagtctcactctgtcgcccaggctggagttcagtggcacgatcttggctcactgcaatctccacctcccaggttcaagccattctcttgcctcagctcttgcctcagcctcctgagaagctgggattacaggcttgcgccaccacgcctggctaatttttgtatttttagtagagacggggtttcgccatgttggccaggctggtcttgaactcctgacctcaagtgatccacccacctcagcctcccaaagtgctaggattacaggcatgagccaccgcgccccacccttttttttttttttaaagacatcttctcactctgtcacccaggctggagtgcagtggcatgatcatagctcacggaagccttgtttcaagtaactggaactataggcatgggcaaccatacctggctagttcattttattttttgtagggatgtagcaataaaactatgttgctcaggctggtctccaactcctgggctcaagtgatcctcccacctcagcctcccaaagtgctaggattacaggcatgagccactgcacccgaccaacactttctaatgacaaaaggaccgtgctgcagcaagggttctgggaaggctctgcctcctgcttgagcctgccttctccccactggcaagcctgtgcctctatgggctgtctgagctgcgtgaagttcctacagcaagagcccttcaatcacctcgacagccaggaagctgccacgggacacagccgggcaatgctcatggcagcacttttcagaagagtgaaaaagcagaaacagcccaggtgcgccccagcctccttctgcaggtggctccggagcaggcagtgggctgggcctgtttggtgcccgtccaggagctgcccagggcagggaggagggagggcagagcctgctgtccccaggaaactgtaccaggggatacagagccccacagagaaacacagaaatgccacagcacaatgtggcttagctccctggataggggagagcttgtgaggtccaggtggagggcaagcagttggcttcctggctccactttcctggatttagtgagcacaaaactgctgcctgctgtgaagccccaggaagacccgccctggggccaagcaaatggtgcatgaggagagccaccagacctctgcgggaccactgtcccctccacagccccgggagaaaggctgggccagaggcggtaccagtttcaggcatctgctgtgctggcagctgagccccaggagaaggttgtaggccaggggagcataggcctctgtgctggagatccccaggggctgacaggaacggtgaccaagtagggacatttgctccagcggaaagcaccaagctcctgcacccacacccaaggagctggaggtgtgcagtaagaagggggttcacggggtgggggcttgccactgggatgaccctcaccacatattagccccaggcctagctatgtccacgctctctggcctgaggccttccagccccaagcgcctcctccctgtgcagccctgggctctggccattctgccaatgtggcctcactcattccttggcagcacctccaggctctgctcagcagcaaagggcagtctccccttcccctacagtcactcccatctgctccttgtcctcatccccacccatgagcaggacatgaacccccagagcctgccagagcatgctctgcacagtaagtaagtgtgtgtccaggcacagaacgcccaagagaaggcccagagggcggcccattcccggagagagcttcagtacctgtcctgaagctggacacggtggccccagttcaaggatttcacgtgattttgaacagcttctgccatcttcctcctgtgaagatacgaaacaaaatgtaaaatccacaacacaggtgttagctgcagggcctcacgatggactattagattcaaatggtacattcatagaaatatcaaaaaacaagagtgcttttaaaggtggcaaaacgtgacatccatccctacgtgcaaccgcctgtcccaggctcagggctgcagacctttggactcacagaaaacaggggctctgacccacggctctccagatgcagctgctctgtgccccaaaggctacccactgcaggcagaggcctatctgagccaatgtgggtgtggctgggccacgtggtccccttcccagaagagctcagctgaagcggcctcccacccgcactcctggccttggagatgcactgttcttggtggggctgtgctgtgcatggctgtagcatccctgggctccccgcaaaggggagcaaacccttccccagtgacaaccaaaactgtctccagacattcccaaatgtctgaggcagacagcgcagagtcgcccctggctgagaaacccatcctacggcccactccccatgagggctcatcgaggataagcctcctcttcctcttccacccaagagtagaagaaaagcactggaatgccacggcgccagatccttaccagtcatgcggcacgggctgggccacctcccagccatagttgggggcatcttggatcaggcctcccagcagtgccgcctggtgcatcagcttcttggggatgcagcccacgttgacgcaggtgccgccgaggccccaccgggtgcctgggacgtgggaagagcacatttgaatttatgttcaggtgactgctggaggcttccctgttcttctagagtgtttggaattccttaaagttgctttgtaactctaacacagaccagctgacatgccacacgaatctgctctctataactgtactcgaaaataaaaacagttgtttttactttttaatatttattaatttatttatttgagatggagttttgctcttgttacccaggctggagtgcagtagtgcaatcatagctcactatagcctcgaactcctgggctcaagtgatcaaggcctgccttggcttcccaaagtgctgtgagtacaggcgtgagcaactgcacctggccagagttgttttcgataatggtcaagaactttaaagtaatgatgagtgaaacaggacactgtccagaaaccatggacagcagggctgaaggactttggtgtcagctgccctctgtacaggaactgggcccacctcccacctccttccccaggacacccggctcccatagggtgctgcctaccttggggagaaggttccacgtagtccaccacggccaccttccttcccagctgggcggctggaaggataaggagagcagcaggtgagcatggggagctggctcaggactcaagaacaggcactcctcagggcttgtgaggtccagaagagtgtgggcagggcctgggcctgcggctgcccacacagtggctgagctgcgcaatgctagggacccctgatctgcctctgcgctctggcctgctgagctgcgctgcctgctggctctgcattgagtcttccagtctctttctggcactgcccacccagctgcgctgcccacaggcaggagccctcagacctctcagggcccgcagcctttgtaccatccacccctcacagtgctggcatcagccccacctgcccctgcatgttcacgttcaccataagcccagtgcccacccaagcatccctgggtggcatcccccaggtagccactcaccgggaatggctcctgactcagaggctctcccttgccccttcccatcccagccagagccccctaggtgggcattcgctgcctcactctcaggaccaggacaccaaagctcaggagaagtgacgcagcagccccagggtggaccagccccagagcaggagccgagacctgactccaaaccacacttcccgctgcagagccacccagttgccctcccagccagcagtgtggccacccagggccacaggttctggggccaactcagaaaccattagccaggaccgggcatggtggctcacacctgttatcccagcactttgggaggctgaggaaggtgtatcacttgtggtcaggagttcaagaccagcctggccaacatggtaaaacgtgtctccactaaaaataaaaattaaaaaattggccaggtgtggtggtgcaagcctgtagccccagctacccgggaggctgaggcaagagaatcgtttgagcccaagaggcagaggctgcagtgagcagagatcacaccactgtactccagcctgggcgacagagcaagactctgtctcaaaaaagaaagaaagaaaaaaaaaaaaaaacattagctagggctaatttcaagcttccatttgcccgggcttgggcactgcatcagcaaacttcaggccttggacttgactgcctcccaaggcacacacaaatctcatgaaccctaaaatgccaaggaaagtgtttgattcgtggctattagaaagcaagattagaacaaagttttgtaagagttcatttttaaaatccattttgcttggctgggtgcagcggctcatgcctgtaatcccagcactttgggaggccaaggtgggcagatcacgagggcaggagatcgagaacatcctggctaacacggtgaaaccctgtctctactaaaaaatacaaaaacaaaattagttgggcgtggtggcaggtgcctatagtcccagttactcgggaggctgaggcgggagaacggtgtgaacccaggaagcggagcttgcagtgagccgagattgtgccactgtactccagactgggtgacagagcgagactctgtctcaaaaaaaaaaaaaaaaagctaatgtccacaaggcacagtggctcacgcctataatctcaacactttgggaggccgcagcaggcagattgcttgagcccaggagtttgagaccagcctgggcaatatagcaaaaccctgtctctacaaaaaatacaaaaattagctgggtgtggtggcatgcgcctgtggtcccagctgctcgggaggctaaggtggggggatggcttgagcttagcaggtggaggatgcagtgagtcaagattgtgccactgcactccagcctaggtgacagagcaagaccctgtctcaaaaaaaaaaaaaaaaaaagccagtgtgccagtgtgtaactcccacatctgaccacgatggagcagcagggcccagatttaccctccccctgaagcaacccaaaacccaggtaaaatgcatgaaacaacgggctttcaggtactccatgtcaggtaacaaaggacctgagagagaggaaacaaacatggtgagccctggggagtctccaggacccagcactgcaggctggggaagatggggagaatccagcacaggagagggctgagaactgggggagactgaggcagccagaggtcatgcacagaagacagtgaggagggggctgcccagagaatctgagagatctgatcggcgcatgtgtcttgggaaactacctgagaccagacagaaccacctggaaggactggaggggacagagcccacacagggcaggggacagtgcctgttcccagaatctggactgggaaaagcatataattcctggggcgttgggtcatgccccagtagttgagaatcattagccctagactgggcactgctccatacccacctaacaaatcttttgcagaagacccaaaaggatcaaactgactcttaataactgcatcccagaacagagctcaataatagtatttctagaaatacaaaaatgcccagaacccaacaaggtaaattcaagtgtctggcattcaaccaaaaattaccagtcacacaaagaagcaggaaaatacacctataaaggggacaaaaaaaaatcagtcaatggagactgacttggaacagacacagatgtcagaattagcagaaaagatcaataaaacaggtattctaactattccatacttttttatttttatttccttgcttagatgcctcacttgtgtgccctaactccaccttatcacatatgatgaactatctgttcatgtgtctgtctcggtaactaaactgcagaactccgtcagtcaggggctttggtcctggtttgtctttgttgttccgggtcctggcccagagcttggaccacattaagtattcaaatggtttgttgaagaaattaacatgttaaaaacaaacctttctcacagaacactgttcctccttcagtgttcaagatcccagacctttgggtccctttttacctacttactccctaccaaaagttctctctccttcgactccagggtggttttataaacctcttatgcatctcaacttgcactatatggtagctacttttcacagctacagacttttggtgtgggaaggatctttttttctctttttttgagatggagtctagctctgtcacccaggctggagtgcagtggcgtgatcttggctcactgcaacctccacctcctgggttcaagcgattctcctgcctaagcctcctgaatagctgggattacaggtgcgcaccaccatgcccggccaatttttttgtatttttagtagagatggggtttcaccatgttggtcaggctggtcttaaactcctgatctcatgatccgcccacctcggcctcccaaagtgctgggattacaggcgtgagccaccatgcccggccaggaaggatattatatgcaatttgttctacctgcttacctgaagtttgagtctccttcataacatcctcaccaagtgttcacctatgcctggtgcctttgtctgggaatgtattgccttcccaagtggccatttaattttgggaactctcccaatataaaatttctcctcatattaattggaaatgttttcctataactcttaactatctccaccccctctcccacatgcccactctttaaaatttaaaactatttttttcctttcccttaagttttctctttttgaattccttcaatgatgactttcaaggatagattccttcaactaggatagtttaggtcacttctctccaaatgacccaccttctccaaacctctgttcagaaggggctgcgatgctcccagtaggaagtctgaggccctaaaaatgggcagctctcgacctgtcctggctctgggctgtatcagccttgaactcggtcacatcaaacatctgacttatagaagttaacaagcagactgggcgtggtaactgacgcctgtaatcccagcattttgggaggccgaggcgggcagatcacctgaggtcaggagttcgagaccagcctgaccaactgtagtttcacgaccagtagtgaaagctcgtctctactaaaaatacaaaattagccaggtgtggtggtgggcgcctgtaatcccagctactcgggaggctgaggcagaagaactgcttgaacccgggaggcagaggttgcagtgagccgagatggcaccactgcactcaagcctgggcaacaagagtgaaactatgtctcaaaaaaaaaagttaacacagcattcactgaaacccctgaggcttttttttttttttttttttttcaaatcttgtggacttctgactggtacaactgcagctgccttgcctggtaacttgggtacctggtttgtgggtccaactgcaggccattcaggtagacttgattttttttttaatttaaaaaaaggcttttttttcttttttcttttaaagagacagagtctcactttgttgcccaggcactggtgtgcagcggtgcgatcacagcttgcttacgccttgacctcctgggctcaagcaatcctcccagctcagcctcccaaagtgctgggaccacaggcacacaccaacgcccagccctcagtggttttgatggattagtgtatccccagaccctccgaaggggaggacagtgccttatctctctctttcttccaccaagaaggccacaaccggccttttaaccttgatccaagcgaggctgaaaagcaaacagggcgttcatcttcatcctttatagccacatagccacatctcccgcccacaagcagattccaccaccccccgcaccctaaggcccagcctcatcagctgcagcatcttcacctggcctttcacactgaagcagaaggggtgacggtttactttcagctgcatggtctccatcatacccgtagacccaacagctgagcttcccctctgtcccttctcctcagctcactgccccactagccattctgcatgttcaaacagtgcaggagcaacatggaagatataaccaaaggctcaagctggattgtagagatgaaaactacaatacaggagatgaaaaatacactggacgggattaatggcaggtcagatgttgcagaatcttttattggtgggtttgaaaacataggaatagaaactatccaaaatgaaacgcagagtaagaaatgtttctaatgaaaagagcatcagtaggttgtggggaagcttcatgcagcctaatatacatggaattaaaagtccccacatgtgaggggaagaaggagggactcaaggccaatgaaaagagaaaatcctaaaagcaaccaagacacactacagagacactaagataaaaatagtagcagatttctcactggaaacaatgcaagccagaagtcagaggggcaaaatttttaaagtactgaaaaaaaaaaaaaaagcggggggccaggcatggtggctcacgcctgtaatcccagcactttgggaggccaaggggggcggatcacaaggtcaggagatcgagaccatcctggctaacacggcgaagccccgtttctactaaaatcacaaaaaattagacgggcatggtggcatgcgcctgtagtcccagctactcaggaggctgaggcaggagaatggcgcaaacccgggaggcagagcttgcagtgagctgagatcgcaccactgcactccagcctgggcgacagagcaagactccatctcaaaaaacaaaacaaaacaaaacaacaacaacaaaaaagaaggcaaaataaagacgttttcagacatacaaaagctgagagaattcattacccccagagccatattacaagaaatgctaaaggatgcccttaaggtagaagaaaaataccagatggaaatgtggatcctcacaaaggaatgaagagcacagaaatacaatgggtgagtatgtgagattttctcacacgatttaagtatattttaaacaaaaataataatgatgtatcatggatttataacatgtaacagtaaacacatgatataataacatagaatgaaggttaggaggggtggaatagatgtatgcttttttaagggtagactggcaagttaaggtacatgccataaaccctaaagcaactcaaaataaatcaaagacctaactgtaagagcttgaactataaaatgcttagaagaaaacacaggtgtaaatctttgtgatcttggatttcttagctatgataccaaaatcataagcaacaaaggaaaaaaatagataaattaggacttcaccaaaatttaaaacttttgtggcacaaaggataccatcaagaaagtgcagggccgggcatggtggctcacgcctgtaatcccagcactttgggaggccgaggcgggtggatcacctgaggtcaggagttcaagaccagcctcaacatggagaaaccctttctctactaaaaatacaaaattagccaggcgtggtggtgcatgcctgtaatcccagctactcaggaggctgaggcaggagaattgcttgaacctgggaggcggaggttgcggtgagccgagattgtgccatggtactccagcctgggcaacaagagcgaaactccgtctcaaaaaaaaaaaaaaagaaagaaaaagaaaaagaaaatgcgaagaggccaggcacggtggctcatgcctgtaataccggcactctgggaggccgaggtgggcggatcacctgaggtcaagagttcaagaccagcctggccaacatggtgaaaccccatctctactaaaagtacaaaaattagtcgggtatagtggtgtgtgcctgtggtcccagctacttgggaggctgaggcaggagaatcatttgagcccaggaggcacaggttgcagtgagccaagatcacaccactgcactccagtcagggtgacagagcgagactccatctcaaaaaacaaaacaacggcggctcacacctgttaatcccaaccctttgggaggccaaggtgggtggaacacttgagaggtcaagagttcaagaccagcctggccagtatggtgaaaccccgtctctactaaaaatacaaaaaattagctggatgtggtggtgcacacctgtaatcccagctactcgggaggctgaggtgggagaattgcttgagcccgagaggccgaggttgcagtgagccgagatggtgccactgcaccccagcctgggcaacagagtcagaccctgtctgaaaacaaacaaccaaccaaccaaaaaacagctgaaatgtccagaacagacacatccacggatataggaagtagattagtggttgccaggggctggggagaggggggaagagactgactgccaatgggtacagggtattttggggagaaactaaaatgttcttgaataacacaggtttgaactgcacaggtccactcatacatggattttttttcaataaatataatcccttgaccgggcacagtggctcccacctgtaatcccaacactttggaaggccaaggtgggcggatcacctgaggtcaggagttcgagaccagcctggccaacatggtgaaaccccgtctctactaaaaatacaaaaattagctgggcgtggtggcaggcacctgtaatcccagctactcgggaggctgaggcaagagaactgcttgaatccaggaggtggagagtgcagtgagctgagattgtgccattgcactccagcctgggtgacaagagcgaaactcggtctcaaaaaaatatatatattatctctccatatcagcaagttccaaatctgtaaccaaactcggattggaaatacagtactccactggacatggtggctcatgcctgtaatccagcactttgggaggctgaggcagacggatcacttgagctcaggaattcaacaccagcctgggcaacatagcgaaacccaccttctccaccaaaaaaatacaaaaagtagctgggcatggtggcgcctgtggtcccagccactcgggaggctgaggtgggaaaatcgcttgaacccgggaggtggaggttgcagtgagccgagattgcaccatttactgcagcctgggcaacacatgagaccttgtctcaaaaaaaaaaaaaaaaaaaagaaaagaaagaaagaaagaaaagaaagaaaaagaaaaaaacagtattcataggatgcaaaactatatatacagagggctgactctgtatctgtgggtgcttcagggccaactgcctgactccagtatgcacaaatttcagtgtccatggattctgctaacagcgggagttcctgaacccagtcgtcctcgggtaccaagggacaaatgcatacgtaatgtgaggtatatctcaataaaactattctaaaaatatgaaacacttagggatgtatctgataaaatatgtgaaagacgtagacattgaaaaccacaggccaggcaccgtggctcattcctgtaatcccaacgttttgggaggccaaggtgggaggatcatttgagcccaggattttgagaccagcctgggcaacacagagagaccctcatctttcttttttttaataaaaaaaaaaaacttgagtaaaaaagaaactacaaaatgctgctaaaagaaatgaaaaaatacctaaataagagatataccacacgatccagttggtccatttttaggcacttacccaaaataatttaaaacatatatccacacaaacacacagacagacgttcacagcaatactgtccacaatggccaaaaggtggaaacaattcaagtgtccagctacaggggaacacgtacacgaaacggcacagccataaacagaacactactcagcaatgaaaagcaagaaaccatcgacactcgcgccaacgaagatgagtctcaaggtcattaccctgagtgaaagaagccagaagaggaagatgacatacagcagcattccgtttatacgcaattatagaaaatgcaaactatagtgacagacagcacatgcctggttgcctaggatgcagaagtgggggaagccggaaggaactgccaaggtttcagaaaatgttggggtgttatgggctgagccatatcccctcaaaatccctatgtggaagccctaaaccctagcacttcagaatgtgactgtatttagagatagggtcttcaaaaaggtaattaagttggctggacacggtgactcatgcctgtaatcccagaactttgggaggccgaggcaggcggatcccttgaggccagaagttcgagaccagcttgacaaacatggtgaaaccccgtctctactaaaatacaaaaattagccaggtgtggtggcaggcgcctgtaatcctagctactcaggaggctgtggcaggagaatcgcttgaacccagaaggcacaggttgcagtgagccaagatctcaccactgcactccagcctgggtgacaaagcaagactcgcttgcaaaaaaaaaaaagaggtagttaagttaaaatgaggccataggccgggcgcggtggctcacgcctgtaatcccagcactttgggaggccgaggtgggtggatcatgaggtcaggagattgagaccatcctggttaacacagtgaaaccccgtctctactaaaaataaaaaaaattagccgggcgtggtggtgggcgcctgtagtcccagctactcgggaggctgagacaggagaatggcgtgaacccgggaggcagaggttgcagtgagctgagatcacaccactgcactccagcctgggcaacagagcgagactccatctcaaaaaaaaaaaaaaaaaaattaggccatatacaggtacagtggccacacttgtaatagcattttgggaggctaaggcaggaggatggcttgaacccaggagtttgaggttgcagtgagctgagatcacgccactgcactccagcctgggaggcagaacaagaccctgtctccaataaaaagccaacaaaataagagggcatccacctgatccattaggacaggtacaggtagagattaggacatagacatgcacagagggacgacaactgccatctacagcccaacggagaggcctcagaagaaatcagccctgcccgcacctggatgatttctagcctccagaactgagagacaataagcatgtgttgtttcagccgcccagtctgttatggcagtctgtttattacggcagccctggcagactaacggggtggaggacacactcgccaatcttgactgcggtactggctgcatggacacatgcacacataagaatgatcaggttgcccattttgataggtacagttcatctcaaaaaagccacaaaaccacgtcatcctctgcagggaaatgccactctcatgaaaggcggagacatacccaggagctgtccacattccggattaaaggggactcaggtctctgcagctggtcactcccagcatgggagtgaacgcacagcccaggtgcccggtctgctaaaaggaacagcactaggcctcgtggctgcctgcgccatcgtttctgggagtggttctgagagtacagtgtggcactgatcctgggtgcctctgcggatccccaataggccaggagacttcccaggttcctacacactccccggcccccacagagcaagagtagtggatttcttttacaccatgtatgcttctagagcccaatactggacatcagagaagcacagcttcagggccaaagtgcccagttaactccctctcatttcagccccacctccctctcatccccttccctccccattcaccacaactgccctcttatcattgtgtagacatggccagagcagaccaggaactcctacagcagggcacagagtctggcaaagtgctggtggcctgtgcatcacgtgggttagcagagaactgcaaagtgtcatctctggacacctctgggtccagcccgttcgcccaacatctttactcaatgggtgccaggccaagtacaagactcacccagcagaactgaccatggaccctgggggaaggcaccagcactaagaacaaggacagggacaagcaggagggtgcagctccagcctcgcagctagccgggcaggggcagagagcaggcaggcagggtgacagccacagtaaggtgaaggagaggactgtccagaagcacgtgaaggaaagtggggagcccacggagggtgtgagtggtgggagctgagactagtcggattggggctgtcactgtgagtaaagcagaagagctggagggctggagctgaggaaggcagttcagccatgaagtgccacggcggccgctgggtacagcagacagctggagagtggcagggaacaagccacaacacagaggccactggggtgaccccagcagggaggcaacgcattttgctcatggacgttttctggacagcaccaccctctctaggggccctaaaagcttcgaggccttgccacgaagtatacagaatacataccctccttggcacaagccaggccaccagatcccccgccgaccaccaggagatcatagtcccgctgacctgctgagagaagggatgagaggtgggacggactgtctgtctggttaaacgtggtacaggatcaattttatcaggattggacactccattctgtgatggtcaggggtgacaagacaccacacaacagagcagaaagagtgactcgatacacatagtctgtgcaaatccagagaccaagccatatggtggtgaggttggccgtgggcgtgtgtgatcatctttgcaaatcacacgcacaccataccaaccactctgaactcaaacctcacccagtgttctcagccagacacagaactaagatattttcttttttattctatttatttttgagacaggatctcactctgtcacccagaagattgtagtccactgccctgcttgggggagggatgaaaggtgagaaggaacacggtcagcacagggctgggacatagacccggaagggcccccacgacaggggcacagtggcacaatcacagctcactgcagcctctacctcttgggctcaagtgatcctctagcctcagcctccagaatagctgggactacaagcaccgatcaccacgtccagctaaatttttttgttttgtagagatggggtctggctatgttgcccaggctggtctcaaacacctggcctcaagcaatccttccaccttggcctcccaaggtgctagaattacaagcatgagccaccaaggtggactaaaacattctcaagtccacgtgcctttcagttgtgaaggctgccctccgtcacaagtgagcaagaataaaagcacaggctaggggcggtagctcacgcctgtaatcccagcacttttggaggccaaggcgggtggatcacaaggttaggagatcgagaccatcctggctaacacagtgaaaccccgtctctactaaaaatacaaaaaaattagccgggcatggtggtgggcgcctgtagtcccagctactcgggaggctgaggcaggagaatggcgtgaacccgggaggcggagcttgcagtgagcggataccacgccactgcactccagcctgggagacagagtgagactccgtctcaaaaaaaaaaaaaaaaaaaagaataaaagcacaagcagcccctgtccctcacagctggccagtgcacacagccagggtcttggtgtgcccagctgcagtcagctaggagggaagccaccctgggcacagggagagctgcctgggctcaggtttcatccctggaattccttttgggctggttgtggtgtcgcctcaccttggtcctccatggtggctcactgcacatagtgccactctcagcctttttagcctgcaaaaggtgtcatcgtgtctactctgcaagctactggcgaggaaggcaggcaaggggcagccaaaaaagggagggatggagaagggactggagggaggaagtagagaggggaagtacactgaactgggcctgaggtccgggacacccagcaccaggcaccagccaactccctgctgaaggaaggaagaaataatagcaagtcatcagtctgctggggtgagggcagggtggggactgatgacaagactctagggtataaaacaagtagtgccctcagcccctctgcagacacgagcctgcccagatgagaagcaccaccctcccagagcatctggagccggtcgctgcttcagacaaggccaagaggttccatgatcagagcagggtctgtcatacaaggctgggcaacctgcccaacacctccatcagagcctagcgtctgccatgagaaggctgcacttatctttgcagccacctccaccttcctaggcaggcaaggctgcagagagtgtacttggagtgtcatgtctctccacaccctggccctgcagatgccccacagacaggtctagaacatgcactcctaaaggatacaagagctggagcctagaggagccctggctcacagctgagaaagcttgggaagctgcatccaggcactcaggccatggcctgcagcgagcctgccccacaaccaaacccacccactctttcacctggcagccagcctctgagtgcacgtgagatgtgtgcgcacctgcgggaactgacagagccacaactcggttccaacagccagtccaaagcacactcaattcctaattcaactcaagggctctggaaaggcctaaattgttgtaaattattctaatggctttaatataagtctagagaaccaaggactgctggtcagggagaaaatgccaccaggtcccccggggagcatgaacctgctgatggagaagcatctctctcctccagctgcctggtagccggaagctttgctcagaacgtccctaccttccatggcaggtgcctgtccttcttgttgccatagcagggcccttgttaggtcatcctgccctgcagcctcgcactgtgccccctctgtctgctatcaggcagggtgagcagctgtctgtatggatgtgcttatcttgggcagcttgctcgccccctgtgcacacccaggagccctctcgggctgataaacactggcatagggcagtcgtttgcaagcataggaaatctgcctttaagcacttggaagggcttgggtagcctgctgggaaggaaggaccccaaagtacctcaaaggtgggtagggcagatgctgttctgtgggaggaagggctgggtggcaggcgttacctggggacacaccacctgtgcactccagtgtcctggagaacctcataaccttgcctttcacccactttagccaggcataccctctccacctgcagggcttggccccagcaagtgtctgtcttgcctctgccttctgacatattgtccattaattttctgctcctctttgaacccactgcctggtacaggccagcaaagagcaggagcccagagctcatagcaaggcccaagagaatgcagcactgcaccagtgagggcaagtggaagggtcccccaaaatgtgcacccacaggcaggctggccacctcagggtgccacctcaggggccctcctgtatggctgctctatctagagctctttcctggcagcaggtgttgtcattctggctcctgttcaggggctgcatcgcccacccactccaagcctgggacagttcaggtcttcctactctaaaaggagaaactgcagggcccacagtcccagctactagggaggctgaggctggagggtgagttgaacccaggagttcaaggctgcagtgagctatgatagcaccactgcactccagcctggttaacagagtgagactctgtctcagaaaaaaaaaaaaaaaaaaactgcacccctagtctgggtacagtggctcacacctgtgttgcaggaagtcaggaaccccgaatggagggactggctggagccgtggcagaggaacataaatagtgaagatttcatttcaatatgaacatttatcaattcccaagtaatacttttatacttttttcttttttttttttttgaggcagattctctctctgtcgcccaggctggggtgcagtggcacaatctcagctcactgcaagctccgcctcctgggttcacaccattctcctgtctcagcctcctgagtagctgggactacaggcacccgccaccacacctggctaattttttgtactttcaggagagacagggtttcaccatgttagccaggatggtcttgatctcctcaccttgtgatatggctgcctcggcctctcaaagtgctaggattacaggcatgagccaccgcgcctgggcccccaagtaatacttttataatttcttatgcctgtctttatctcttaatcctgttatcttcataagctgataatatacatcacctcaggaccactgtgataattgtgttaactgtagaaattgattgtaaaacgtgtgtttgaacaatatgaaatcagcgcaccttgaaaaagaacagaataacagtgatttttagggaacgaagacaaccataaggtctgactgcctgtggggtcaggcaaaaagagccatatttttcttcttgcagagagcttataaatggacgtgcaagtaggagagatatcgctaaattcttttcctagcaaggaatattactattaagaccctggaaaaggaatgcattcctggggggaggtctgtaaacggccactctgggagtgtctgtcttatgcggttgagataaggactgaaatacgccctggtctcctgcagtaccctcaggcttattagggtggggaaaaaactccgtcctggtaaatttgtggtcagactggttctctgctcttaaaccatgttttccgttgtttaagatgtttatcaagacaatatgtgcacagctgaacatagacccttatcaggagttctgattttgcccttgtcctgtttcctcagaagcatgtgatctttgctctgccttttgccctttgaagcatgtgatctttgtgacctactccctattggcacaacccctccccttttaaaatccttaataaaaacttgctggttttgcggctcaggtgggcatcatggtcctaccgatacgtgatgtcacccccagcagcccagctgtaaaattcctctttgtactctttctcttcatttctcagccggctgacacttacagaaaatagaaagaacgtacgttgaaatattaggggcaggttcccccaatatctggcgcccaacgtggttttctttttcctaagtgcatgtgggaacccgattccctttggtaggtgcggagaaatgttcatcggtccagtccacagaaatgcttgtttggctccccaacgattggtgagttgtctgtgtattctccggggtaactatgggtcacgcagagtctaaacattatgcttatctctgctatattaaattcctgttaaaatgggggagttcgggttcccatggaaaatatggtcaccctattcagggcagtggaagaacactgtccttggtttcctgaaaagggaacgttagatgtggaactatgggatcatgttggtgcaaaattccgagaactggtcccaacaggaaattatgttcctgtcactgtttggggtgattgggccttggtacgtgccatcctaatgacataccaatcccgtgacaccctgcagttaccacagttttctgaatctggccaccctctacctcttcctcagctttcctctcccactcggccttcattatctgctcagcccctccctttgcctactcctcccccacctgacgatactgaggattcaatatctaactccagtgactttggcttaacatcaccccctgatgatcttatttcttttcacgaagagccgacacttgtagctcctgcggccccaactcagacagcccaggaccatatctatgctaactcttccctctccaaacctttacagtctttgcctccggagccatccaaactacaatttacctgtaattctgcaggccctcccccatccaccacagcccctcaccctcctatcattttggtccctcaaccggtcactttgccatccactcaacctgcttctctgtacccttcttcatgcagggacacccctgccactctggttgtgcaggactgggccagtaatcaccagtatgcttctgcctcttctgctcccccaatgcccctttctcacactcttataccagtccgaccccgtcaatctcagtttctcttatctatacatacttttcctgtcacttctatgccgactctatctcatgtgcctgctcttgaaactttcatgcaatgcttattacgccaaaacaaacaagtagattagaggcgtgggcttattcggtcatgctggaacctcctaatgctcaaggggtacaagtgtgtcgatatacgccgctcaatcttacctttttaaaagaattcaaggatgcttgtactcagtatgttcctacttctccatatgttaaaacggtattacagactctttgtaccgaggtcattttgcttcctatagactgcgaccttttggcaaaagctgttctaactccatctcagcatttacaattccatacctggtggtcagaggaggcccgcctgcaggctcagctaaatcgggctgatggcattccaattactcaggctcagctcacaggctccgataattactctgatactactgctcatttaggctttgatgctctcaccacggaacaagtaacaaaggtgtgtatgagagcttgggataaattacgcaccccaggccaagcttctgtttcttttactattgttaaacagggtcacaatgaattatatcttgattttttagctaaattacaagatgctgttgaaaaatctgtctctgatgagcacactcaaggtattcttcttcatatgttagcttttcaaaatgcgaaccatgagtgtaaaatggccgtgcattccatcctacgtcaaaatttacctgatcatgaggtgttgcctgcatatattaaagcttgtgaaggcgttggatcggagacccacagagctattctgtgggcaccggccatgaagcacggcaaccaaactggctcgactgattcttttcttggagcctgctataattgtggccaacttggtcatacccaaaaaaactacactgttaaaaacttaaaagcggccaagccggctcaacaaacacggccaaatgctcctgctactgtttgcctgcgttgtcgtaagggtaaacattgggcaagtacttgccactcagtctgatatagatgaaaatcccttgccacagaaccagggaaacaggaagcaaggccagtcccaggccccaatatcaaatgggacacctcggactcagaccaatgttgtgtttttgcgtcaagcagtcccaacgcagcccccagcacaaacaaatttacctacagccaatccagatgggtcccagcctcttcttctgtctcagtacaatgcttgtctacctccacagtaggcagcagggcggtcgatctctgtagtaccattcctctaaatttactacctaattctttgcctttaattgtccccatgggggtcactggccctttacctcaaggttcggtgggcctggtgttaggcagggcatccacctcatgatactaaaggtatcatagttcatactagtctcattaattctgattcctctgatgagattaaacttatgtaaacttatggtgtctgccaaagttcctgtttccattccggccagtgagtcaattgctcaattacttttactacctaacattgttttaaacaaaggagataagacatggggccctgggatgggctccagcggtgaaaaagccgcttattggattaatgtaatttctaaacaatggcctacctgcaccatacacattcaaggaaaaaaggttgagggcctagttgatactggggctgatgtttctattatttcctctaatttatggccttcctcctggcttaaacatcccactaacatgaaactagaaggtgttagaaaagctgaagaagttcaccagagcacatttatcttggcttgcactggccctgatggtcaaaagggaacaattcagccttatatcatgcccatccccattaatcttcggggcagagatttgctggcacaaattggggctgaaattaatattccacataacttttacagtgctcccagtcaacatataatggaaaacatggggtttgtttccagactcggtctcggtccaaaacgtgaaaaaattactaaacctcttcaagttactgtaaaagaagacaaggctggtttaaaagcataatttaactactccccactcccaattatatttagcattgtttaagctttctaaatgttcctaaaaacaatactctgactgcagctaaatgccattatacaggcaaaaaattctccctaaacgaaggcaagccagtgtcatggaaaaactcccaaaccaatacctgggaacctggaacaattataacgtggggaagagggtatgcttgtgttttaccaggagatcgtcaatcccgtctgggtgcccactaggagacttaaacttcgtgtgaatactgacaataaaaaccacgaggaagagacgttcgcgtcagagactgccctcatacctgatgagatctgtaccgactcctcagaaactggcatgccaaatcaaaatgggtctggttcaatcctccctaatggcaatgtaaacccctctaactaatcccacttctcctaattatctttttctccttacgaacctaaaaatctcaccatttctattagcctgaaaataacatccctctgttcttctcttcctccttcagcactggatctcacttacaataggttttatttaataattatcttccttacactttctgtctcaccagtttccccttaaactgatttacctgctacacaaaattattcttattgggcttatgtgccttttcctccacttattcgacctctcacctggatggatgctcctgcagaaatctatactaacgatagtgtgtggatgcctggaactacagatgaccgttgcaccgctcagccaggagaaggcactgcatttaatgttactatgggttataaataccctcctctgtgccttggacatgcacctggttgtatccatctagaagctcaagtctgggctgcttgtcttccagagagattagctatagggaaatggggacatttggtctctggcctctccctttctcctttaagacaaataaaaagaggagtaataggagataccccatactttcaatataaacctgtaggaaaaccatatcctaaaaattttgagggcccatctaaaacttcaatttgggaatgattgtgttaactcacatgcagtagtattaaaaaatgactcggctgggcgcagtggctcatgcctgtaatcccagcactttgggaggccaaggcaggtggatcatgaggtcaggagattgagaccatcctggctaatacagtgaaatcccgtctctactaaaaatacaaaaaaaattagccaggcgtggtggcagatgcctgtagtcccagctactcgggaggctgaggcaggagaatggcgtgaacccgggaggcggagcttgcagtgagctgagatcgcaccactgtactccagcttgggcgacagagcaagacactgtctcaaaaaaaaaaaaaaaaaaaaaaccccaaaaaaacaactcatatggtttagtaacagactgggcacgaaagggctatttaaaaaacagttgctcctctggcggaaaggaatgcctggagactacttattttatttcttactgggaggaccaggatcatcatcctattttgcatagaaggttcagtttgttctttcccttaaaataggaagataagggcattatccccctaagtctcgtatgatattccccattctgagtccagaatacctagaaatttggaatttggctattgccgtgtctggactgtgagtatgggaaggggaagcttttctgtctgttgtccccactaccgcccctcacatccgtgattctgaaccccatgataaatgccctttgaacctttttcctccttttgatgccgaatccccttttatgggactccgccagcacgggtgcatttaaccttcctgagcttgcccacctgacgcatgcagccaagaagctttgaaagatggagtgccctggctgagggttccaggtctcagcaaggccacgaggtggtgactgcctcccagaactctgttgggccaccctccgtcctggagacccccaaaacctccatagcaccaactctgcccattcacacacacagtcagccctccctcccgagtccaccgcgggcagagggccagccaccatgcctcccatagccgccatccctgggaaggagccctgaccccgtccttacacccctctacactcactgcctgtggggagagctgctcgctgtcacaagcatccagggggctgggtcgaggggccccctgcatggtgggggaccatgttgtcgtgcatggaatgaaactggccacacataacagatatggtggcgctctggtcggatctaggggagtctgtcctacaggatgaggcttgaactgtcctgagtgaccagacacccagcctctgcttcgagtgctcagttatgattattgtcctgatttagttaactgttcttcaggggctccaggaggacgagtgtgtatcctcccattgctctgtgcagcctctaacctctagagtctaggggtctggggagaagttgggaagtctggccagtggggccggtgcctggtgacctcgggaggtgggatatcatcatcttcagaactgtagttgttactgggataccagctctgggagaccacaggtgcagtcagcacagcaggaccttagacaaggcacccagccccagtttccccacctgggaagggggctacttgtggctagaagcagcccggactcctgagcaagactagaccaagaggccggtatgtggacacccccgcgtgggcacccccacggggacaccctggccaccgccgcgcggacaccctcacgaggacaccccggccgcgcggacacctaccgcggggacgccccgaccccatcctacctgctgcgccccgcgccgcgccccgcaccccgcccgccacggcctgcgtccgccaccggaagcgccctcctaatccccgcagcgccaccgccattgccgccatcgtcgtggggcttctggggcagctagggctgcc

SEQ ID NO: 1077 - DNA, 29275 bp, Homo sapiens
gggagttggggagtagggaagaaggagaggaacatctctttagcatttgttcattctaacattcacatgtttgcttctccatggagttgtttcactatgaacaggttcactaaggagccagttatgtccatatgaaatgagaataaaagtgcaaactcattcagatcaggttcttctgagtggtgtttttgaaaaaaatatgtaaaataaaaatagaaacattctttgtcaaatacttaaattgcagccacagtagtgggacagccactacttatagaacacatgtctatttaaagcctttttttaggccaaagactgacacctatgcaattgatgtaggaaaagaaaggataaatgaagaaaaagaaagaacacttcatgttagacaatttagtcaccttcataggttttgacagaattagggatgcagaattgctcctgctgaggcagtgggagctcccctcaagctgaaagcgtgaagaggtgaggaggcagctatctacaggccctcagggacagctctttgtctttccccaaatcaagcatacaactacaaagtcctgctgctccacttccaagtcaaacttaataattcttaggtaactctaaataaatcttaagtaacagagtattctctgatgaggctcgtccctgtcagtgccagtaactaaaagccaagatgttgcaaatgattcttttattattttccaatcagccaacagtcctcacttagggctttcttccctttttacgcaatgactgtccttctccagagaaagcgacgaatctgcctccagcttcatcctaggtttgaagagaagatactattttcagaaactccctggaggtttacaataaatgccttactctatggactcacgtaccatccacattactcataagaaatatctcaggctggacacgatagctgacacctgtaatcccagcactttaggaggcctaggtgggaggatcacttgagcccaggagttcaagaccagcctgggcaacatagtgagatcccatctctaccaaaaatagctcagtgtggtatgtgcctatgatcccagctacttgggaggctgagacgggaggatggtttgagccagggccatagtgagctatgattgtgccactgctccagcctggatggcagagcaacagagcaagaccctgcctcaaaaaaaaaaaaaaaaaaaaaagtctgtaagttcatcacccaaaaacatttcaggtcacttttctgtacatgcttaaagaattgttttcccacttaattctgaaatctcatgccaataaacttcctgtctagtatactcccaaggctacagaactgaattctgtaaaaaagaattccatgatgtaggagggccagttttctaccagtggacattgttgtggtaagcagcttaatgtatttgcacacaactctgattttttttagagctcaaattcctgggtcaaagtgtgtacacacttttaatgcttttaacatatagagaccaaccagccctcagaaacattccactaagctatccttccatcagcagaaagagggattgttttttcccaaacctttgaaaactgcacatattttttttcacatgcttttattgctagtcagtctgaggcattatctcaacttttccctaggaagaagaggattctggaatgttcaacacacatccctgcacctggctccccactaactgtagcatgttatacctgcaatagagcactgtttagtatttatgtggtcacattcatgtaaatttgagtcacagctgcatttagtcttcctttgccgcacagccttccattcatcctggtgtcaatagctgtgtttggcttcttcctctattcaatcacagcctgcattgcatggagttcatctgttttgacaaacctgtgtctcctgggccttcgccctgccgtacctggactggcctttctctaggtgccgtacatgttagtgggggctccttatttcctggattctatgactttcttatttctaccttattccttcattttagtgaggaacacctcctaggagcttcctgagaaaagatgcatgaggattatcttcttgtgagttccttttttctaatctcatatttcattgataggctggttggtatgttagtctgctagggctgccatataaaatgccaaagatagggtggctcaaacaacagaaatttattcttcatagttttggaggctagaagtgcaggatcaaggtgtcagcaggtttggtttcctctgacacccttttccttggcttgcagatggctgccttcttgctgtgtcctcacatggcccttcctatgtccaaatttcctcttcttaaaaggacaccagattgaattatggccaactctaatggtcttattttaacttaattgcttctttaaatggccctatctgagttactgggggttagggcttcaacacagaaacactggagggacacaatccagctcataagagttggtacagaattttaggttggaaaaaatttcccctcagaattttgagtatattgctccactatcttctagtttcctctgtgtcctgctaagatgatgtccctttttttgggagacagggacttactgttacccaggctggagtgcagtggtgtgatctcagctcacagcagcctccacctcccaggctcaagtgatgctcccaactcagcattaaagtagctgggactataggtgcgtgccaccatgcttggctaatttttaaaattttctgtagagacagggtctccctatattgcccaggctggtctcaaactcctgggctcagatgatcttcccgcatcagcctcccaaagtgttgggattacaggtgtgagccatggcgcttggctgatgatgtccttaatgcatggtgatacctctgttctctctctagaagctttaggatctttctttgcctcaaagtggggctattttcattcattttgctggaactcagtgagcccttcaaatctgcaaaattgtgcccatctttggggaaactatttccctgatgatttctgctcctttggtttctgtggctgttcttcccacaaatcctctattatttagatgctggaatggaaagctttctgactgtggccttcacttcagagatagtagtctagagacctactggagtcgagcctccagccttctgggatgggggagggagggtaatgcagctctaactgcttagtaacagaattctgtctttagtccctcatttctagaggtgccttttgagaattccacaatctacacagaactgcttctaggctttctatggtctactaaggtacctggggcttccaaagccttgtagttgcctcctcttccactgtctttcttacctcatgacctttagccacagccttagtggggctgcaggatggaatagagctaaatatgtcttcaatcccatctttaaacatatacttcttaaatacatatttatggtcaaacaggcctgctgtgcccactggcctcccctgccttctgtaaatttgcaacagtcaggtcacagtcagcctgggggacgtcccatgctaaggtcttaggtcggagtcaggcactggcttttagtgagaaaggcagcctgtagctggtgaagcctggatggtgcctgaaggaggagctggagggtgaggtctgactggccactatgtttgctcctctgagcctgaaaggtcccaatgcccaatgctgtttcaacttgaacattgagcccagaagtggttgtgagtaggaccaggtgtgcaaacttcacagtggtctctgtccccaaccaccccaagtgctagagaaaagagttcagtaattgggatggctcccatgtagcagctggtcctgaatgggtggctcagtacatctgccctctgccctgatcctggatcctcaagggtccaatcctttgagaaaaggaaccaggagagcgatgggtctgaagcgctggtgttgtagaaatcctcatcacaaagaggtgactgcgttccagttgctgccaggcctggccatattcccacaaagtgcccatgtctacaggatgctcagcccttgccttcctctgtcccgccaccaccctgctcagctagaaggtgctgcctatatttgaagttcaaggtctctgttggaagacgaagcccacccagggcacacagttctgtgataacagagcctggagtcggctctagagcaagacagagctcctgacccccatgctgcaagtcttctgtttcatacaccctacaccagctctacagaaaaaaacaggacaccagggagcagagggaccctaggaaagggaaaacatgacagacaccctcatgtggtttggctgcgtccccacccaaatctcatcttgaattaccacgtgttgtgggagggaccaggtgggaggtaactgagtcggtgggaggtaactgagtcatgagggcgggtcttttccgtgctgttatcatgatagtgaataagtctcatgagatctgatggttttataagtaggtgtttccctgcaccagctttttctctgcctgctaccatccatgtaagatgtgacttgccccctgccatgattgtgaggcctccccagccatgtgaactgtaagtccattaaacctctttcttttgtaaattgcccagtctcgggtacatctttaccagcagcttggaaacagactaatgcacacccctactcagaatgccaagaacttcagtcatcactagcaaataaatctcctcattaccaaccaaggaaatacaaggaaatacactcacctcttcaacctttttgacaaggggacgtgaatttctgatgaaagttatcttaccaagtttaaattcataattgggaattcctctgtaagaagagacagagacagagaaatgttatttccaggaaaaaaggactaaaattcatttttgacagtcaagaggaacgcagaaaagatgctgctgcaccccacctgggccctttggtgcttcctggcatcctcccaggagggaagcagaaagtaactgacttcttggtttggtatcaatattgggtatagggccaggggctttaggctctgtacctgtctatggagaggggtcatctgaaggattgggaagccctcactgtcactgtcctgagcttcacagaaccccctgaggtggctagactctcactccagtattctgatttcacacacacaacagacaactgacacacctcagccctgcccctgccatcatggccaccagaggaagggtctgctgtgggtccccggacccagcaacagaagcacatctgaggtagctcctcagggaactttcaggggaactgagataatgtgacctgattaataattccaagtcacaaaacaggaaaataggcagatcaccaaatagggaccagaaaggttttgagtaagagacagatctaatcagactcgcatcttaggaaagccagtgggggcaagaagaggctgaattgggggtatggagaggtatggagagaggctggaccacagtggtactgggggtggcactgtggaaggaggggcatgttgtgctccaccccaccaaggagagcagctaagggttttagtcccttgggagactactgacccaggctttgtctccagaactggggtgaggctgcccgaccccagcgggctggcacagatcctcctcctgtcctggaggagagccaggacagacctaccttttaatatctccaggcttgattggggaggggctgggctctacccctttcttctttccatccagtctattgccagatccagagaaagcctagacaggaagtaggtgagtcatataataagcccaagtgtgaggacgatatgtcctttgcttggagatcactgcagggatgtgagctgggggtgctgtgcagaccccttcaggactgaagccctgactcctcaactgctggggtgctggcagctaagaactctgcccagttcctcagggggtggccatgagctgaagacagccacttggccaagggcagccagcagtcagtgttgggttaaaagacctgatccctgcctctgcagggccacccagttcaagctctatgggtgggctaaggctactgttgtgactgccccatagctcagcttcccatcattctgccctctctgctgcttcctggcacctcctgccacctcagtgcccacacatgaaccacctccacctgtttcccatggagccttgccagtagttatgctaagggtcatgtttgcaacctacatggtacaggcaaagaaaaaaggaaacatgatttacaagagagagaaagcaaatgtggtaacttttggtgaacctaagggaacagtatatgtctactgtactatttaaactcttcggtaggttagaaattcttaaaaatctgggctgccttatggggctgttgggaagattccaggagagagtggatacaaaagggtttggtaactgagcgagtggcagatttgcatatgcacaggtacccagaggcctaacccctgctgatgtccatcgagcatcatggagaacaccttgagtgagtgctctaatttcaaggagcagagggcacagcaatataagtcaagtggtctggtactcacgcggaagcccagctctccagcatagccactgtggtcggcttcaccttcctgacagggaaaaagaaaaacaggtgagctcctcagcggggacacccagcttccctctcacccccacccccggctaggatgtcccccggaagcatggctggaagggacgcagaggatatgactacaccaacactagcagaggccacccacgagccactgccaggaactcaaaagcagcatgcagcaggacagcaaaggacactgaggataacacttactgtcgactcctcatgctggacttgtctttcgggttctttgtagcccaggggagcatcaaagtccacctgtgtttccaggattttaaaagtaaaatattgagacatgaccacccttggcttccttttttgtttttaattgagacaactgtagattcacatgcagttttaagaaataatacaaaagatgccttgtacacttgcccagttttcccaacggtagcatcttacaaaattacagtaaagtattgctgccaggatatcaacactggcacaacccactgctcttattcagatttccccagttttacatgtttttgttcatgggtatctttagttctacacaatgtaatcactgtgtggggcatgtatccaccacagttgagatgtagaacagtttcaccaccactaggactgcccatgttgtctttttataaccatacccagctgtctcccagccccctccaccagtcctaagccctggcaaccactggtctgtcttccatttcgaaagttctgtcactttgaggatgttatataacgaagtaactttttgggattggctttttttgctcagcagtattccctagtaatacaaccaggatgctgtgtgcatcagcacttcattcctactcagaaggttcagtacgcttccttagctcttaagcatattcactcctcggccaggcgcggtggcccacacctgtaatctcagcactttgggaggccgaggcgggtggattacctgaggtcaggagtttgagaccagcttggccaacatggtaaaaccctgtctctaccaaaatacaaaactagccgggcctggtggcacatgcctgtaatcccagctactcgggaggctgaggcaggagaatcgcttgaacctgggaggtggaggttgtagtgagccaagatcgcaccactgcactccagcctgggcaacaggagtgaaactaagtctcaaaaaaaaaaagaatattcactcctcaacgggtcagagctaaccatggcagcactggcagcaaactctgttgccccaactggccctgagatagatcacaaggtcacagtctcctcatgatgttctgacagcatcttcctcctctttacccagagtcccaggggctgtttgatgccctcctgacaccctggcctgcagtggtcaccaactgcccatcctcccagggcccaggctcactgtaactggacagagccactcacgttcatgtcacactcaatgatggacactgccttgtcgggtttggtctccatcacacgcagttcgtagatctgtggggcaaacacagaaatcagttggatggtttcctggcagcactggagctgtcgctgtccatgttactgtggctctactggctcctgcgaatgacacagcattcatgcccatgacacaacctacagctgcacttcttgctgtgacaacactgccataagggacaggctgccctgtgcccatcgctgaagagatgctgttccccagatatggttcaaattagacaaggtagttatacagctaactgcaaaagacactaacaacctttaacctggaaagttcacttctggaactttactatttattttatttatttatttttagacagaatctcgctctatcgcccaggctggagtgcagtggtgcgatcttggctcactgcaacctccgcctccagggttcaagcacttctcctgcctcagcctccctagtagctgggactataggcatgtgccactacacctggctaatttttgtattgttgtagagatggggtttcaccatgttggccaggctggtctcgaactcctgacctcaggtgatccgcccacctcggccacacaaagaactgggattacagacataagccaccgcactcggccttcgaaatttattctaagtaaataactagctatacccaatgagaaaattctaagaatgctcataccaacgtcactaataccactgtacagatgctccttgacttatgatggaaccaagtcccataaacttataagttaaaaatgtattaatattcctaacctaccaaacatcatagtgcagcctgccttaaccattctcagaacacatacattagcctacagttgggcaaaatcatctactataaagcttattttataataaaatgttgaataactcatgtaatttattgaatactgtactgaagatcaaaaacagaatggttgtataggtattcaaagtatggtttttactgaatgtgtatcatgtttgcatcataataaagttgaaaaattctaggtagaaccatggtcagggactgtctgtatactcaaaatgcagctgaattatatttcttcatatgtaaatttacagttatacaatggtatgctacgcagccaacaggaaaataattgtaaaaccagtcatgttgcttgtgtctaagatgacctcacctatgtaaaaaaggcacataaaaaatgtccagaagcagggccgtgcgtggtggctcacgcctgtaatcccagcactttgggaggccgaggagggcagatcacgaggtcaggcaaatgagaccatccttgctaacatggtgaagacccgtctctactaaaaaatacaaaaaattagctgggagtggtggcaggtgcctgtagtcccagctattcgggaggctgaggcaggagaatggtgtgaacccaggaggtggagcttgcagtaagctgagatcgggccactgcactccagcctgggcaacagagcgagactctgtgtcaaaaacaaacaaacaaacaagcaaacaaacaaactccagaagcatagaaattaaaagtggccctatctactttttcctgcatcatttcaggttctttgcttttatctaaagtctgtcttgcttttttttttttttttttttcgagatggaggctcgctctggcacccaagctggagtgcaatggtatggtcttggctcactgcaacctccgcctcccgggttccagcgattctcttgcctcagcctcccaagtaactgggactacaggtgcgtgccaccacacccagctaatttttgtgtttttagtagagatggtgtttcactatgttggccaggctggtcttgaactcctgacgttgtgatccacccgcctcagcctcccaaagtgctgggattacaggcatgggccaccatgcccggccagtatgtcttgcttttacaaccattttaaaaagtctggatagtcccaccatttaaaaaaaaaacctaagcagggccaaatctacttttaaaagtgtcataattattgaatagataaggaataaaaaaaggatctgtcattgtgtggatatactaccacttatccactgagcatccggcctgtttccaatcattttgctgtgttaatgacactactataaacattcaaacatgtctcctagggcttggctcatgcttctctaccgttttcatgttttcaaaaggccacaaataatcagtgggtcataaaaccaacagggctgcaagcagaactgaaaaggaaagaattggaagacagtaccctagaagtactattgcatttagtaaggataaatattcctgtgacattttccatttacttttatgtattggcataatattaaatactttttttttaaactatgggaccaattttctaggttggtgctcctcaaactacctgggaagacctagtttttaaaaatgtgcagtctgctggactgccatgtggtcctcctgcacagaagcaagacacaacacacaccagacgcccagagctcaccaagacaagtactggttctgtggccatgtgtgtggaggttatgacaatgccaaattactatacgtttctaaacattcacttttgattcctgcttcctcgaggccctggcaaccaccattctttttttttttttttttcccttgaggcagggtcttgctcagtcccccaggctggagtgcagtgccttgaccctggctcactgcagactcaactgatcctcccgcctcagcctcctgaatagctgtaactaggcacatgccactacgcccagctaattttaaaattttttcattaattttttgtagtgacaggatcacactatgttacccaggctactctcaaactcctgggctcaaacaatcctccaaccttggcctcccaaagtgctgggatgccaggtgtgaaccacggtgtccaggtgattctactttctgtctcccatgagtttgactactctaagtactcatgtaagcggaatgtagtatttgtctgtctgcatctggtttatttcactgagcagaatgttcatccatgtggtagcatgtgtcagaattcccttcctttttaatgttgaataatattacattgtatgtgtgtaccacatattatttacccattcatctgcaatttatttttgactatggtatgagttaggaactcaatttgttttttcatcttaggaatagtcaatatcccagattccgcaaccccagtatctcctttgcctggtgacatcaatgctgcctcagtggtggaccaagattctttgtatataaagctttcttccactggcctacttgtctactccagaaccaatgccatatggtgtcttaactactggagctttattacactcagctgccgtatagaatcttccttatatatgaccagattcttttgtcaatattttatctacaatctatgtatctgtatcaagtgacaatgatctgtagtttacctttctcctatccttgtgtggttttggtgatcaaggttatgccgacctcagagaatgagttgggggatatgttctttctctatttttagaatatctaagagcaatttattgcttgagtgtgaggaagaacttgcatatataaccatctgggcctgtgtttcctggattaagatttttctgattgaattacttgactggctatacaattatttaggctgtttgtttttttttttctttagtcaaacttcaattacacttttctctaggaaataatttatcaatgtcaaataagttggctcatttcttagtataaaatttttcacagttttatctttcaagatatttgctttatctaattcattttatttgtttttaaacattcaatatgcatgtagacttttcagggtttgctttttttttgtttgaggcaaggtcttgctttatcacctaggctagagtgcagtggcacggtcactgttcactgcaacttctgcctcccggactcaagtgatcctcccacttcagcctcccaggtagctgggactacaggtgcatgccaccatgcccagctaatttttgtattttttgtcgagatggggttttgccatgttgcccagtctggtctcaaactcctggacttaagtgatccacccacctcagcctcccaaattgctgggattacaggtgtgagctaccacacccagcttcagctatcttttttattaactttattgaattgtaaacagagaacactttaattctaaacaactctctcaagagagtaagtctaggccaggcgcggtggctcacatctataatcccagcactttgggaggctgaggctgatggctcacctgaggtcaggagttcgagaccagcctggccaacatggtgaaacctcgtctctactaaaaatacaaaagtagccgcaagtggtggcacatgcctgtagtcccagctactcaggtggctgagatgagacaggagaattgctcgaacccaggaggtggtagctgcagtgagccaagatcgcgccactgcactccagccagggtgagacaaagagagactctctcaaaaaaaaagagagtaagtctaaagacttactcttttccaacattttagatgtcattttttaagcttcatacattaaacattattactgctttatatggcaacatttaccctggattcatatttgccaatttatttattccctattccttcttgctttccttctaggataatgcttattcctaaagtacatgcttttaaaattccattggtaaataacctctctcagatttggttcatctgaaaatattttcactttgcccttattctttaaggaaggttttgatgatagttacttgatactggctgtaactgttgctattcaaagacctgctacttgctgttcttctgaaggtactgtgttttctccctgcttacctctctgtatttggtattttctacctgtagcttattctgtttgttatacattataaatttcctgtcatgatgggctgaccaccaattctaaatcaatttcagttaccatctcttcagattattgcaattcctccattctttcctactgggattgcaatgggcatgtttgactttctcagtgtcttcaacatctcaagctctcatatgttccatccccttgctcctctgtgtgaaattctgttatttcttcagattcatctttcattaactcttttatagctgttgtttaacattgtttttcaaatctttctggttatttttgatagccttttgttgctcgctattataattccattttaaaaaatatctttgaacattttatatctaattattttacatttgtatctagaaattctaatgctgatttccttagggatctaatttttattgtctctgctttggtgtagtttaattatgtgttctttgcttgttcaattgacagcaatcccaaagacgtaactaaactggagtgctttttccagagaggatctgtttatttctcctgagacaatgacaacacccacctctgtgtatattttactgcttttaagggttcccgttcaatcctgatctctgactcagatctcccactagagcactgatatggccatctgccctcagggcaacccagcttagagtgtttaaaattctctataagcacaacagtacattaatcagaagggcccattagaggatctagttttccctacttctaaaagtggaagttcaaacctgtgtttcaattttacatacactcttatataatgtaccctcccttagagtgcaaagtatcagtactatcctttatcatcagtttaggagttatatgtagtattactaccttaacattaaaaacaataacattaaactgcctgtaattaattataaaagcttagagtattcagttaaggtaaacgatacctaaaatgttctccacaaagctaaagggaacaagattatttcttagtttattaaaaggaaaaaagaaagtgtgattcgaaacccaaggaactgaaaaataaggtcagatgcctcaaatatgaggaaactgccagagaataagctggatccctgcactgacaccaagggagtaactggctaaaccacaggcagctgtgacacagctgtgacggcccagtccccgaagggaccagagagtgctgtgaaggagctaagtgctagcttcagggaaagcccagccaagccaggctgtggtcactcccgaacactaaggctagccctggcaacagctctgtgggagggtcaattgtcaacagtcacagtgaacaggggcacccatattactgtgctccatgcctgtggtgggacagcctgatggcaggattgccaactattacatcctcctgcaggcatattcccataggtaataggaaagtgaatgctttcttgaattttggactaagtcctgtcatttcactttacagttaaattgtctagatccagacacctaaacagcataaaatcagggatgaaaacagaggcattcagacctgagagacttgtgtcagaaaggtcaagcctagagaagctgctaagtgaaaacggaagctgaagaaaacaggaggtggaggaggatgtgggctcccaggaggagaggtgagcctaggaggtgttgccctaaggcagagccaggctttgcttctcagatgccacacagcacttggccccactgaagggcctgtcagcttctgtggggcaggtatcccaaggacaaggacccagcagggttgttattgtgtctccacagccctgcaaagggcttagctcagattagaggtgcagtggggacctttcaaaccaagacagaaccagcagccttgccaccaaggtacacagaggtatgactaataagtctatcaatgttcccctgtaaatgcaatctatcctcaaaacagagttaccaaatgaattagggctctaaatatgaacccgggaaaacttaataaccaaacagtaggcagtaattaggtgataagatccaggcatacgctgcttaaaaagaagccccattcaaacattagaatggacactgcaggtggctcttgtcaggaatgacctgcatgaactgggctcaccttttcattatagttgatggcaatcacatccccggtggtcagacaggcaaagttcctaagtgcgttttctaatctgcagacacattctgtcaaggcaacatggcaagatggataccttaatctgaaacaagtttccatgttagatgattactggtaggtagagactgtaccatgatggtacttgaaacacgaagcttttaatacaataaagtactacttggcaataaagaaggatggaactcctaatatgcaataatatggatgaaatgccaagctggggtaacaaatgccaagctgggggaaggggaaataaccaaccacaaaagggcagtgagattccatccacatggaaccctgagaaagacagatctatgaggatgggaggtagctgagaggtttctgggccaggggatcaggtggggactgacaggaaaggaccttttggggacatggaaatgttctgattacatgggtgtatacattttcaaactggctgaactgtgtgcattttattgtatacaaattataccatgggattttaaaaaatcctgtgggagtactaaagaacaaaaaagatttaatgagtcagataggtcctctcaaaagttcctcaaaatcaaagatgctttcatttatacttctgttgtttctatcttttgagctgataactttagttaatagaaattaaaataaagaaaccagcaaatactttttataacagtaaaactgtagaacccaaatgcccacacaaggaaatgtctattcatgtggaatattttgccatgtcttcctcatcaatttgctgaaggactttacataaaaaggtcacatgaaatgtggctccagagcctgccactgtgagtccaacttgagggtgaaagggtgaggctatctaggttcacctcgcttggtcaaacagctttccagaaccagagcaactttgtgaaaagcgccttatgtggtggatgctttctttgctcccaaatatgaagtgccacggtacgaagtgcccttccctccactcctctagtgaccctgccagggcatcttctctgacttccactgcagcagctggaggagcagagccagagccctcaggctgagaacacgaggcctctgcaggcagggcgggctccccatatggcctctgcgtactctggcacctgctgcagcaccagcttcccactttctctgctcggtgccaagactgctttcatccagacctcagccagaccagaaaacaccaggctctcaactgatggaagtgacgccctttctccacacactaacaagttaattgtgctgacaaaacagcatctgagatcaacctgataagtctgcattggggcagggcgcggtggctcatgcacgtaatcccagcactttgggaggctgaggcaggtggagcacctgaggtcaggagttcgagaccagcttaggcaacatggtgaaactccgtctctactaaaaatacaaaaattagccgggtgtggtggtgcacacctgtaatcccagctactcaggaggctgaggcaggagaatcacttgaatctgggaggcagagtttgcagtgagctgagaccgtgccactgcactccaacctgagcagcagagtgagactccgtctcaaaaaaaagtctgcattgcaacacatgtaaaaaccctgagaaaatgggcatggcccattcctggtcactgacagccaaacaagcatgtctaggtcagagctctgaaggacaagttaactagctcttcccataggacatccccctgcctgtgggacaggaggctcaacaaggccatcgtgtccagaacataggcagcaaagaatatacatggcccatatgcatccagagcacacccagcagtgccttgctcctaagaaaacatgcggagagagcgctactgggaaaggaggcagcttttcttaacttcctatctgtctgtgttgtttgactgtttgttttttttttcaagtatgcattaaaaaaaaataaaaaaaaagaagtagaatggagtggccactcttatgccatgatcgtaacaggaaaaatcagggccatggagctagagatcttgattggtgcacacagcaccgtcccgtacctgcactgcctacttcctgatgctgtcaacacatacacctggcttaagttcagaggtgaacaaaaagaatccactagaacctgatacctttgctttctgcttggtgacatagaaactgcagtcattgctacctattggcctggagtgaatcagctctcaggctggcatgcagtgaggttgacgggccagtgcacagctgggcggaggtactagggagccacagaaggggctggagctgaaggcagataagctgctccctccttccactggacatactgtgcatcctggctttgtgccaggtgacacagaccaactgaaagaagggcttcattgtggtctccatgaagtgtctggaaagtgacagaggtggcccagacagcacccagtgcacttggccagggccacgcagatgtgctagctgaaccccattattctcaaatcacaacttgaatcacaaatgtgtgatccccaaagcaggcacagattcaatacagtacatgatgtttaacaaccgccagcacactctcctttgtctagaagaactccgcttatttgaaaaagatacacggctttggggttggtgatgtccaggaagtcagggctctgaggttggaatttggagtaggtggccacttgaaggttgacgctctccacctggaccaggccgccttcttccaagagtaagttctgcatcatctgaaaggaagaagaggctacatgagactcctagagatgaagcagcctccacaaccactgctccctatacactgggcaggcccgtcttacttgggtccttggaagaggaacctgagccaagataagtaattcgtgatactatgtcaggaaggagggaaaaatcaagtgatgtggaaggaagaaggccaataaaggggtgctactgaagctgtatagctcacagtgtgaacgcatctctgcagggctgcccggattactcactagctccaggcttcccaggggcagagcattttcctggaatagtcactcactgtacttccaagctgtcccacaagcaaattataaggccctgcgtcaagtagggctgcacctgaggtaggacaaaagcagcacaaggcaaggctgacctggcaatggaatggcccaccacagctgaggctgcaagatggtgacagaccccagaggtctctgctaaggaggttataaaaatctgacaaagcctccacatgtctctattaaacaacccagccaggtagacgacggctgagaagtgagacggaaagagataaacaatgcccatgagtactgggtgtgcagggagtccagactcaggtcagaagctctatgtctcttgcaatgaaattttgcttgtcttatttgaaaccgtcttaaaaggggtgtcagacatatacatcagtagaaagagccgtagaagagagctcccacgcaccgagccctgacagttggacagtgctcacgtcgtggctcagtccatcgatcagcactacctcacacccagtcccaagccacattagatgccctgaagcaaatcccaggtatcacatcccttcaagaatgtttcatcgggagtggcagtgagaaggtgactttaacagccaagggaaaagggggctgagggctgtgtcacaaatgagagggagctcatgaggagggagaggcatgctgaggccgaggctgtgcctgggaagccgtgcctaggccatgagtgaagcctgagtggtgggccctatggataggcttgcagaggaccccatgcactcacgctgacagctgcttgtcaggctagtaagggcagaaatagagggtggtcactctaccaaatgccacaggcaggcacagaaggatgcagaggtgactggctttggtaacgggggtctggcatccccaggagtgatgttctaacaggaagtattctaaggctcagagttagccagtcgcaggccaggcgcactgtccctgggtagatttttgtgggaaatttgtcagcgaggggaaggatactgggctgcaattgcaagcctgagggaaggctggccagggatggggggtggcttcctcagccagaggcaggacactgccataggtgatgtgaggaggacaggcagagaggtcagactagggcttgaggtgagaaatgggctgctggaagaggcctgagagcactaagcaggcaggaggagctgatgcctggccctccccatgcagcattttagagcatacagcacaacgggcagccgagtacccacatgtcacaaacggctagtccagggctcggatctaggtcagcagacgaagccttggctacaaggaaaaaggccagtacctattccaggctggctcgccctgaagaagcttgggagcatgggtgggatggagtccaccagccagcccagaaaaagcactggctcacatgccctccaagacagcagatggggtatacctgtcacccgcctgcccatgccaggagctggaaggccagctcaggggaagaggtggcctgatggcttcacaccccaaaccagctccaggctacctaaagaggctttccaggggagaaagggttcaattagtttcctggtctaaagcagtccaacagcttggacaagaggccacccaaacttcaagtctatgggttaaaggagaaccttcgagatacagtgtatccccagcatcaccacctcctcttataggtgagccacagaagggactggggaagtagtcactgcctgacacttcagctacctagagtggcttcagtgaccaggtgttctaccggatgagcacaatgtggcctcaggcccttgggggcacctgcagacaaacacaagaatagcaaggggctgagcagcaaatactggggagggcaggtgagccaatctgggctttgaggcataaaagccccccaacaggccaggttgggcaggcctagtcagctgaggtgaggaggcagcatgggaaggccaggcactaggaggtgcaatgggagtgcagggctcttgtcggggagacactggccaggcccagaccttgggaaggaccctgggacccaggctgaagaggatgccactaccatggcagcatgggcaaggtcacctgctacagcaggaaagagaccttcagaattttgattcatattattgttgttttttttttttgagatggagtctcgctctgtcgcccaggctggaatgcaatggcatgatctcggctcactgcaacctaagcctcctgggtttaagccattctcttgcctcggtctcccaagtagctaggactacaggcacgtgccaccacacccggctagtctttgtatttttagtagagacggggtttcaccatgttggccaggctagtctcgaactcctgacctcaagtgatctgcccactttggccttccgaagtgctgggattagaggcgtgagccaccgtacctggccagaatttcaattcatatttaatctcagaaaatattagttaaggccatcccttctgaacgtctggcggccaccatgatagggcatcagcaggagaggtgggctgtgcttcagaccacctccctggtggcagccaagcaagcactcctgagagtttccagcccacagctcactgcggggtctctcagtatgcctgatgtaatccaagcacaaagagaaggacaagcaggtccctttgtgaacttccctaatgtgccagagctggggagaggagtgaggagaagaaggagccaagtgggccacagctacctgtgtggaactctcactgctgcaggctcctccctacagcactggcacagttctgctcacttctctgaggggtacagccttgagggcaggctctggtggctcacacgccctggatatcccagcccagatctgcaatgacatccttcaagtcaactttccaaagagagcctgcttgtaaggaaaaagacgtcactcccatggcagctcagttgagagatttgggagactacgtcagaggtaactgaaaacatgtatgctgtgacagactactaaaagtaggggaaaagcataaaaacctcaaacaccctacttactagaccacctaaaaaatactgttgctccattatttttaaaaacgcctcacccaggaaatcacagatgaacagttcagctgcgcaactatcaaagaaaaggccactcccacagcacagtggcccacaggtgcgtccagagcccaccagcccgcataaggcacagtgcactgctctggatcccttctctctcgctgggtcggctcaggctaagacgctgagcaggaggagtaggcggggccacctgctccagggccaggactctcgagtgcaggagatgtctctgcctaagtggctgctctctagagaccctggcagccccactcacccagtgtgggaggtagcagatgccctcatcagccacaaactccagcacgccacaatgcgtcatgcggtccgaattcttattggtcagtttgaacagcatgggataggtaatgttaagtcggcctgaaaataagagagagactatgaggcacagctcctatgaagggacacctgttcggcccacgccttcccatagaaggagcctccccacaatcctgccctcaaccccacactcctctggcagatgaatccccctctgtgagagcacagtgcacggctcaaggaggaacctggcaacttggtaacacagcactggcatagacttgtgattttctgaagtcaacattttaaaaagtgatgtgttcattcatttattcataaataatttcagtgcccaccatgccctggacaaaatcccgaccttcaaaggtttctagtttgaaggtagaaaccttccaacaaagaaaaccacaaccagatgctgcaggtgctgtgggaagagctggcaggagggggcagagctactgggctaggctcctagaggccgagttctttaggctgggcactgggcgggcagacctgggaggaaatccaggcagaggtggcagcctgagcaaaggcgtggaagggaagaggagcccaggcagttcagaaatggtggataattaggcaagacaggctggggacaggtgtgcgagtggttgggaaggggaggggcaccacacggggtagaacctagggcctgggcccagcgggcagtgtgagctctcagcagggtcatgacataggacgccccctctctctgatggaccttgaggtgtgggctgaaagcaaggccagaggcaagtaagctggactggtgacgtgctgacccaagaggtgcacaggcacataaaggaagggctggcaaaaagaggcaggaaaacccaggagacactgggcccccgggagaagaccgagaaggaactgatggtagtgatggtgtttgccatgtgtaaggcccttgttcagtcttcccagaacagtcaggtaggtactatcattatccccttttatctatggggaaactaaggcccacaggttaagtaacagcacacaagtggtgagcacacaagacctcacagcacacaagtggtgatgccaggattcaaaccaaggctgctggcttaagtccagggattcaaccatcaaagcagaatttagcttgttagttcagacaaatattccaataaaaatcacacttagtgttaggaagtaacgcagattccatttgagatctccctaaaaattctaataaagcaaatcaagttaaaagcttgggcaggaagctacagagaacctctgagagtagcatggaggtacagtaagggtgggcactccctcctatcaccaagggtgactctcacactggcagtaaaggggccaggacctctgtcccggtccacctctcagctgcacagccatggagctgacatacagctggtccacagtaaactggactgggctcagccaagggtctgagattgttgcaagtgaaagagactccaatgtccctcagtccactgactctcaaactgcattttgtgacttagaggctcccagtgccctggggctcccagtccctctgtaccccctcactttctccaaaaaaagcagagaacctcattttatgaattagaggacttcctataagatttagacagaaagagtttctcccatcacttaaaagatttgaacaacactgatctgagctacacctcaatgacccagcccctgagtctcttctggacacctgtgccaagggtcacccctggtgtctggctcctgggtcagcatgacttgaaaggaagacctttttagggagcctgttctctcctctgtaatgacagggtcttcgtgagaactgtgaactccatagctctgttgacctactggttgagctgaggcctccactgggtatagccacagccagtgctggctcaggggctacctccaccttgtggttggaatcggatagcttaggttgtcacagacactacagtacttctgatgcacagacactgtagatatccccaattaaagaagaggacattgaggttcagagaggtcaagttgctactctggagtcaggctgggcaaagagcccgaggtgagtcacaccacagccagcacctgttctctgcttgctgccaccagaggcccccaaaaccaagcatgaacctgtcctcctggccaaccccagtctcctgcctcacacaggaagaattcacaccagaaacactctttaagtctggaaggcaatgactgcatccttgattgggttgtccatgatagggattttctgtgcctgtgtagtatggggctagggcatgggtttccaggttgctctcatgggataaggggtcagagaaaagggaggaagaatgtggccactcttagaacccctgtgggcctatctcactcctggtaagaggcaggagcccagcaagaggagtggcttctggatggaagacaatagctcagtttttgacatgctgaggatgcattggtgcactggagattagaaacgggggtctgggccgggcatggtggttcacgcctataatcccataactttgggaggccgaggcaggcaggtcacctgaggtcaggagttcaagaccagcctgcccaacatggcggaaccccatctctactaaaaatacaaaaaattagccgggcgtggtggcgggtgcctgtaatcccagctactcgggaggctgaggcaggaggatcacttgaacctgggaggcagaggttgcagtgagccaagattgcgccactgcactccagcctgggcgctaagagcaaaactctgtctcaaaaaataaataaataaataaataaaagaaaagaaatgggggtctggagctcaggaaagatgtttggtgaggggatgaggaacctgctcacagcgccctcttgtgagctgaccaattcttcctttaggaaaaaaatctagtgagcccagccaatggcatcagctgccctggcacggtacaaagcacttgatacttgtaccttcacttaatcctgacagaatactgagaacagttggggggtgggtggaggtggtgatcaggaagggaaagggaacccccttcacagaggaggaacctgaagcacccagggcagtgatgaagctgaggttcagggggccctggcctcgccctaggtacctgtgacccaggttctcccagcccagcgcatgccctccacggacaattcacaaccagatgctgacaaagggcactggtgtctggatgtactgaggagcccatgctgactcttggtgtccatatgtacattatctaagtccttaagtcactcagaagatacttactgagttggtccagggccgagggtggcataattactgtggaaagaacatttaagaaatattaaaaaataaaaataaaaaggacagaccaaaggcaagatgcagtttctttatatctaacaaaaagccttaaactgtttttagggtagccagaatgtcccagtgatctttcatgaagaatcttacttgatgtaatttattttgggaactgaatggttatcagccataaacctaaccataattagcaccccaccccaacagagcaagtcagggataaatcccagcaccattttcacagtaacactagcttctgactcccacatgcaaagtaagtactgttgaaggctacagcattgcagacttagggcaggaaaagttactattcaaataaaaacaagcacatactcttccctcctttctccacatctgacctgtcattaggccctgctagcatggacacagagaagcagcggtactgtgtggagaagcggttttggaagaccctgggaatagggtggtcgaacatgttgaaagagaactagaaggaggaaagagaaacaagtattaaaacaaaggtacatttcttcatgtcaaaagccaaaacatgtcagagtaattaatgctactaaacattgtcagagaacacaatgtactgaaatcttcaatgtaatcttactaaatacaaaacaggccatgccaagcctgtcctgaacctttttcagggctatgctcccatcttcatcctcaggatcaaggcccaacctcttgcatacctcagagacttgtactgacagccccacagactcctgcctgggctagttcctctgccttgaacacttttcctattatcattaatctaaacaatatttgttaattgaaacatctctttattgagtgcctactgtctgccaggctctgatatgagcacaagggaagcaccactccagtgatgtctgtccactaacaaaatagataccacccctgtcctggtgaaaatgacactcaaagcaagagagatatacactccaagcaacggacacacacacatgtgtgtctggcagttctgaagacaagcagcagggtaagtagacacagggctcctgggaatgctattttaaataggtggttaggaagggactctgcacaaagacctgaatgctatgagagggagccaggcaaaaaagagggaaagacattccaggcagcaggaagaacaggtacccagtggttgcaccccttcccctgggttccaattaccatcctttcctttccccaggaagcctctcttgctctgctgagggtcaggtctagtgcctctccagcgtgctctcacagcacaaagtaggtacacgttacactatgttatgatgctttcttacagcaacaagcaaagctaaaacatgatgccattaaaaagataagatcctagatcttaaactgtagactaagatgaggcttagcaaacatgtatcaatttgaaggttttctcaaagtacagtattcctcccaccccccacccccatatccacaggggatacattccaacatccccagtggacgcctgaaaccacagataatactgaaatctatacatactatgttttttcttatacatatctacaattttcttatacatatctacaataaagtttaatttataggctgggtgcggtggctcacgcctataatcccagcactttgggaggcagaggcaggtggattacctgaggtcaggagtttgagaccagcctggccaacatagtgaaaccctctctctactaaaaatacaaaaattagccgggcgtggtggtacacgcctgtaatcccagctactcaggaggctgaggcagaagaatcgcttgaacccaggaggtggaagttgcagtgagccgagatcgtgccactgcactccagcctgggcaacagagcaagactccatctcaaaaaaaaaaaaaaaaaaaagtttaatttataaattaggcacagtaagagattaacaattaataataaaacaattacaacaatatactgtaataaaagttatgtgaatgtggtttctattttaatatttttggaccatggttgacctcgggtaactgaaaccacctaaaatctcacaggaggatatatattcaaaagaactggaggcagaatcaagaagagatttttgtacaccccgtattcatagcacaattattcataatagctaaaaggtggaagcaactcaagtgtccaatgacagatgaatgaataaacaaattgtggtatggtatatacatacaatgaaatattattcagcttttaaaaggaaagaaatcctgtcacatggatgaaccttgaggatatcatgccaagtgaagtaagtcagtcataaaaggacttatattttatgagtccgcttctaggaagtacctagagtaggcaaattcatggagacaaagtggaacagagattgacaggggctgtgaggagcagaaaatggagagctattgtttaatgtgagtagagtttcacttttgcaagatgaaaaagttctgaaaatctgttgctcgtgaatgtactcaacactattgaactatagactgaaaaacggttaagatgataaaaatttggtttttttaaccacaactaaaaaaaaatctgtattagagaaaatttcttgacttgattccaaatatatatttagtagaaggaatgccacctactgacaaagcagtttactagcaactccaaaattagcaagctgaattagccatctcccaaaatgcaaacatagcatgttcccgcctaaaatctgggatggttctttactccctggcactctaacacagtaatttccaatcttttgtctttcttcttttaagcagcataactgttcagctaaatcttggccagaaccataacacaggaaatagcgtttctgggtgaacaaggccagaacagggtaggggcttgcttcccttgagtgcttctcactagccaacctatgtaagccatttcttctctttgaatataaaaggtaaatccgcacaaaggggcaacatacttaacaacctgcctgcagtttacccatgaacccgaccttctgccccttctttgctgctcccgatcccatctctcactttccttttcaatcccgagacctagcacactgcctggaacatatcaggtattcttgagtggatgaactcaagaatagaaataagccagggtttgacagtgacacacttgggataaaatctaacaatcattccttgtctttactaaaataaacaggtgacaggaagacaataccgtagagtgctttgcagccagacagacttggcttcaactctccagtccctacttctgtgactcgaataaagtacctctgtaaacgttagttttctcatgtttaaaatcatcatcatccttgcttccaaagggattgtagggattaaaagaaataagccgcgatgagggagtacaggtgttaaaagctgtgtaacaggaaatgtaccagcaggtattagcttccatcgttatcattaccgaacacaacaccgctgtacagattcgaaggcacgaacccgtaggcacggagctcacggagctggggcaagagctgggtgtcccccaagagcgggggatgcccactacggattctccctggggagcgccctgattctgttcccatccccagcaaccttgcaactaactttgggtttatggaaacctgttgcgcgtccagcacttgggaaacccgtgaatggacacaaaccttcctttctttcgtcaaggagggcaagtccggctgagacagaatgcgagccacgttcaggaccggcggacgcgaccacaggcggttagtggtcaagggtcctgcttgtgcccggtgcggccgatgagcctgcaggccggactcaggcccgggtgactcggcacctccgccgccgtcccgccccgccctgccccgccgggccctacctcaggccccgggccaaggcccagcccccgcccgctgcccgtcagcgcttaccatgatggacaccacctggcagactccgctcctctcaggcaatgcaacgaagaaaccccgccgaccgctctcccagccgccgctgccgctgccgccgcgccaagccggtacgccccagaggctcaccggaagt

SEQ ID NO: 1078 - DNA, 29275 bp, Homo sapiens; identical to SEQ ID NO: 1077

SEQ ID NO: 1079 - DNA, 134088 bp, Homo sapiens
taagagaagtaagacaatactcaaagaatatttattgttgacgcttttttccttatatttaacattttgagataaaggctaaatgagtgtatttgtgtgcgtatacaagtacaatcaatgtgactgtgacaactgcaaatgcaaagctgataaacatgtgttgccttgttgactcaaataccagaagctgcgttgtcattgatgaaggaatatttcgaagcgctgaacaattcttgataaagttccgaaacaaacaaagcacaatcttccctcgatttacatgggagttgcattcctggaaaattcagtatattttaaaaccatgcaaaatatccttttaaaaaaatatgtaacatggagtttaggaccaaggctcaggtaactataaaaatttttacctacataaatttctagtggagtgtttgaaatttgtttaggactgtgtccttcattgtgggacatttgcagatttctcccttgcccactaaatctcaatagcacctcctccctcaattattgtgacaatcagttcctccacattcaacaaattttccaacacctcccgagcagcactgccatccttgttgagaacgtgtatctagttcatcttaagatagaactgcccccctcatccccactttctctcccaaatcctgtgaaagcccagcacaggcactgggggatacagcaagccacttaggaggattcccagcttgtgtcattgaatcatctttaaatttatttttatttttttttatatgtcttatcatcttccaaaaaggatgttttggtgaactgcaaagagatatactcagagacaggaaaaagatctggtagggtgaagaatgaaagaaaaacaggcaggcagaataaagctgaaagctgagcctagtatctaaaacgcacactcccagggcttgtatactcaataaagttgagaagtaactgggttgtcaatttaaagaggaatacttgatcagacacacaattctatgttgataagattaaaaacaagctctagtcatccttccgtacctgtaggagattggctgtaggacctttgtggatgccaaactctgcagatactcaagtcccttatgtaaaatggcataagggaccatttgcatgcaacctatgcccctcctcccatatactttaaataatctttagattacctataatacctaatacaatataaaggctatggaaatagttgttatactatattttttcatttgtgtcatttttattgttatttttaattttttagaatatttccaatccatggttgggtgcggaacctgcggatacagaggactgactataatatcaaggtaaggacatggattctggacccagactgcatacattcaacttggcttcacttttacaaactgtaggaccttgagcaaatcaccacatgcttctgtcttgttacctataacaggataatatcactacctacaataccacacaagtctattgtgaggattagataaattggtgcacataaagttcttaggagagtatacagtagttacttgtaagcactatataaacatttgccaaataagcagaaaaagttctcagagaaaacagtttttaccagcagtttttctcactaatagatgtggaattgaattacctagattgaaaactcagaggaaacttgacattcatcaattctaatctgtttgtgttacagtgcaggaaactgcagccagacactgaaagtctaggggccaagctcacatattagttgaggatccacaagttagttgaggatcctggtcccctggttcttttctgctgctcttgccaatatctcggcctggagctggcctgtggaggggtgcagagaagcagcctattgtctctccttcccagagtgtccacaggttccaaaattctaccttctcccaactgttctataacaccccaaactctcatttcttcctaaaggacagagagcaaagaataaatcaggtgtgaatgacccctaaactcaaaccctcaaggaatatgcaaacacatagtagagttcctttaaatatagtaaatcttcaactttgaggaagagggcgaatgggtaggtgggaggcaaaggttttaaatttagaaattaaaattgaattgtctaaactggcaaaagtctcaccactttccagttgtgagactgcacacaaagttacttgagagtctccaagcctcatttttctcttctgtaatgtcaaaacagagatcataaggctgtcggaatggactctttgtggcaataagataccatattataaacaggacccaaggtcatgccaggtaagaatgaagtcacacacccttcctcttaaggaataaactatattgtaactgcctcaaggttttttctttcactctagcagttaaacaagcactgataagtctccagcccaccatgaacatgggacacatgcaacatgcatgtttgctttactatgtatgcgagcatcccccacttcctaaatatttattgccccctgtaacctgctgaatatgtaaacataaacgtggccaaaccgttcagcataaattcctgctttacccctctctcccttgaagtgcctgcttttggtgtctgctggaggctatgcttcccagcctatcaggatggccacctgcaggctgtaaccttttgttagaagtaaagctctcctctccaagtttctgaaccttgtgattcttcagttaacagtaacatggggatgataataatcaacacctcatgggttgttgtgaagaagaaatgaaataatacaaagcacctagcaccatgcctggcagagaggggccaataaatgttcatcatatttgctattattattattattattataggcatcagcaacctatcagaagagaaatagttttcctttgctctttgaagaaaggaggccgccccagaaaggctttattcgtgtcctcttactccatgaacttagttaccttgtagaggggaacgggaatgtctggaaagaaagaacctgaagctcagtcccgataggatcacatgaagcgtcacaaagacagaagggttgcagggctgaatccaattcaaccactcactctagtgtgttcctgagagtgctgtcttctctctctgacccttaaacaaatatgtctacgttcactgtccagaatataatataagacagggcttggtattattaagatgctgcttactaaatgaggaactctgagatattgcacaagaaatctagaaacttcatgaattgggggtgagtctcccaatggtgaaagttcaggaagactggctgcaaggggctttgcaaaatacacgcttataaacacactttctcttcctttaacaaggaaaatgataaaacttcatagttacagcgagaaatactgggaaacaaaaaatacgctcttaaaatttcaataacttcatatattcattctacttagctgttacgggagagaaatcaaatatcttactgttgattttcattttccaagggactttgaactatgtgtgtaggtggcagtaaataccttcgttatagctgctgggagctgcagactctgcacacacaggtgaaggtggttagacttgtgtttcctgggaagcaagggcaagtaaggagtgtctaccatgggccagctatatgcctttggtattccattcaacaccctcctccctgtgttagaggaaacatttctcctcctgcattcttcccagcctgtaacaggactttctgtcctctgggggattgggaagttatttcctgccccttcctctttttacttcttcccaagggaaagaatgacttctcttcttagggaggttggagaagggtcctaaacagcgggctctcttgtttaggctgactgtgagacaattttttcattgcttctgctttcctatggggagaaccgttgaatcgtagcctgggatctggaggttgatgtctctcttcttgctctccagaattcattgatttgaggcatgcatctgacctccatgtttctgcaccacagactcaattctcctcatgtgcaggtccagacccagctggggttgtatcattttgaaggtcatctgattgcaggtccactttaagggctcctactcaacaaccaataaaggtcctatattcatctgtatttgctgaaatatgactatttctcaattggttcagaatcagagaagctctactacccagaagagttggaacgggccttgaaatgtaacccaagcatcttattatacaggtaaaaagccaaaaatcatatgcccctcttgccagctgaccttcccagaccccacccaggtctggccacataataatgtgcattgcccaaggtggcttgattgcctggtctggcagctggaggagtgggccctgcacctgacctcactgtgtcttggctttgtccaagtagaccccttgccttcgattgttttgtgcctaatgttttcactcatttagaaacacctgcatctttcttcccctggcagtgctctgaacccttttttttgccgggggcactgtcaccagtgtcttgagatatgttcctgttctgtatctgaccccagtggaccggaacctgcacgtaggtctgctgcctccctgcctagcgctctttctgctcccaccagggtgcatacctctgtgaattacatggctggacttctcttaacatcagactctattaactagaacaatagttttatctcatcctgtgattcaaagacggttgctagggaaaccagtggggatatgtttaatctgtaaatcctgtaattgccctaaagtagcaacaattcatgtgcttgcttcaaaaggatttggactgaactgactgggaagcaggtgagtgaagaagaacaatcacaggttggctccccttgtgatctgttcacattcctcataaggtgttttttcctgctgctttgccaaaaagctaaagggattaaagagggagcactgcggtgcccttctaatggaccaggaaagctagaaagacaaaattatgcagttcttctcttcttatggattcaagtggtcagagctgagtgattggaggctgtactggtggtgatggagagagataagaggataaatactccattttattttaaaatggattcagaatcctataattgtagtttgtagggggatactaactccaaatgaggagaagcaaggtatttgggaagtcttatcagaagaggccagggtggtctaagcataggagcacagagtcgggtttggaggcgtgcccagcatcatccccgccaagcctttccttaatccacagcagtattcagtgggtcacccacatgctgcttgggcactgccaaaaatggagaacttgctccttcccagagcagctcattttgtgtttaaacagccctgattgttagaagatctgccttaaattgaactgaaacatggggtgctgggggcaggggacaattttcctccttgacttggctgtctggcggagctcacagaggtttcttcataagacatgccctacctctgtcacagggcccacacccagcaagccacactggctcaagggcccagaactatccagaccgttgaagagtcccaccttgaggcacaggacagaagcagtagggagaaaactaaacattccttgatgtagtgtttgattaagaataaaatgcacagcttctgtctctcggggccctgcaatgtttgtgatttaaaaaaaaaagcaaaatctaagtgcagaccctgtttcccaggagaaaagtcacacgaaactcttctttatacaaaatggttctgagaatcatcactaccattatcggtggagatgactcagtattctagacttagctagttatgcaaagtccagggaggtcattgtgctctcttttggaaacataatagttccattaatgcagctgaatatcacatttgctctgagcagctgcatcccactgctgactcatgttgagctctacaatcagtgaaaacttggagggtatttctcctttgtaggtgcaatatcatatgatccctcctaagcccagctctattgggactatgggtgtccagggtccctcctagctccttgcctgcttttgctgtcaagtttgtgagttcaccttctgtattttaaaattcaggattgcagcctggtgcgatggcttgcacctataatcccagcactttgggatgctgaggcagaaggatctcttgagcccaggagtttgatcaagaccagccagggaaacatagggagacctcatctctactaaaaataatttttaaaaaagtagccaggtgtggtggtgcatgcctgtagccccagctactcaggaagctgaggtgggaggatggcttgaacctgggaggccaaggatgcaggtagccatgatcgtgcctctgcactacaacctgggcaaaaaagcaagacacctgtctcagtaaaataaaatttaggattgcagggattgcaccctcctgtctctggttctttgttacctatcctgatctgtgaagtcttaggcagtcactgcctgtgcatagttgatgtatctatgtggtcccattctcttcagctctaatttatccagaccagcatgtttaataaggttagatgtctgatctaccctttattaatgtctattctcttttccaattcattgacagaaaagttggaggaaagccaggagccagggagttttgctttctttgatctgttgaagcagcataagtagtttacctaagagtatactgcccttgtgagaggtaacaatgcaagattttggaaaaagacatctaacctgagtgcttatactttgcataacccttttgcattgtttagtactactggtttttatgctacttaattgttttaaaacagggatttataaaaatagacacaatttgctaaattctcattcagttcagtcactcttaatggaaagtctagttttatatgccacaaagccataaccaaggtgccacctcattgtagaaaaagaatccagaaagaaagaaatggttttgagtagcaactttgaaaattccaaactatgaaacaaaggcagaaatcactgttacaaggtccttggctttccaggaagtccaaaacccaaatgaaaaaggcatcttgattttctctctgaactctgctcaaggtttactaagaaactacctaccacgtataaatgggaaacacacaaaagatgtatttcttggaaggtgaggggtgttagtgattttggcctcacattaagggagccagaacctgcctgaactgctagaaataaggggtggaaagacaggactgggttctggggctgcatccagggaaaacatgtcagtaccgtacacctaacaccagatgagtggacagagacatgtcaggagaaaagaggaaaaaggaatgccccgggctccaaaaagaaaaggatatgggattggtgtaagggtctgagggatgagagaaaagaaaagatggtgatacataatcacttctcttttttccttcagaatgatgacctaaaactaaacattggtcactgcaatcaaagtgttaatatgaaaaatcaagtacctcgctctgaaatttcagaatttcttggtggggagttaggactaggaagaatcacagccaaaaacaactaacagtaactcccatagcaatgctctatatttaagatgtagatacatccataatatatatactctggagtggtttattaaaaggcacttcgagccattcataaagaaataaatgatagtgcaaggcagccggactcaatggccaggaggggagttagcagtgagtgctcttgaggagatgccgaggctgggtgggcagagggtacttcgaggggggcctaagggagccctcagtgggcctgggtgatgatgtcctcagaatttcccagtgtgtgtgacctctgcagcttgagtgttcctaagggaagtttggaggataaagacagcatctctgggacaccagaccagtgtccttcaggtctgggagccccacagagcaacagctgggaaagtatacggttattggaggcaaaacaatcaaaattccattccagaaacgtgtcccttgcaaacctaggtacctgctgctcactgttcaatggtggcagacatttcagtgtaggcagctcagtgcttctcatgcatagacagactgcttcccacttccccacccaaggggcacctggaaacgcgtgtgcatgtgtttgtcactgtgtgtgtgtgtgtgtgtgtgtgtgtgtgtgtgtatgtgtgggtaggtgggtgggtgagtatagaggctactggtatgcagtgtccaggacaagagatgcttaatgtcctgcaacacgagatcagttcctcagagcaaatatggaccccattataaaacaatgtgctttggacactgtcaagaggaaattcccttaaaagaactaaatgtataccttactgaaaccaactaagtcggtatgcatttgaacgtgtatattccaatgttttctgcttttaaatttaaaagctcttaaagttagaaaatacagattagcataaagaaaatgatcaaaataatcctcattcctactatttaagtaattaatatgttggtatcgattaatgtgtctttccatttatttatgaaaataagacaaaattatgcatactatatttttagtcagctctttttaattactatattgtgaatcttcattgacttaaatagatccttttgtatataatttttagttgctgcctcatactgtattttatgtctgtaccattgttgaactatcctccattgttgaatagctagattttttttttttgctattaacacaatgtggcaatttatctttgaacggttttttattgtcagagagcaaaaggatgtttaacagctggaaggtaggaggatagatagagtgacaagagtttaggttctgcaatgagaagacattgcttcaagtcccaactctgccacttactagccatgtgaccttaagccattcagctcaacctctttgcctcagtatcctcatctgcaatatgagaataacaatacttacctggcaggatagcacaggagattaactgaagaaatacatgtgaaagtacctttcaactgtacctcactctgagagagaagggggaaaaaaacatgatcttccatttactgtgaatctctcatatgccaggcactttcctgcgttttacgtgctttattgcatttgatcctcatggcaaacctgtaaggcaggggctatttttttattacccacatgttacacagaagggaaatgagacatgtggataatctaccccatcatgggcacaacggtagaagcggcagcacagagattcagacccgggtctgcgggacacaccccaggctctgaggtggatacaatgcagaagagaagcacactccccagtgtggcaggaggccagttctagagccttccagacccagctccccgggagatgaatcaccagctagggacaatcccgaggccaaaaagctcatgatagcctgctcacagtcttgaatcaataggtcttttattagtctttaaaatggggaccacaatctttatatgtatacaatattcgtgcattccagagctctttcccatccattctctcactgttctgacaatagctctgtgctgtgggtggggcaggaatcggcttgtgaagcatcatcctatatgttaggacagggaagactggaactctggatgcctggtcccaaatcatttgaaatttgaataatcccagcttattggaaaaggaatcctgtcttttctacttggtatctgtgtagctttgggtaactcatttcatttctcagattttcagtttcttcatctcttaaaagagaccaaaagcaggaataatgtttatgtcaaggattgtcctaaaatccaaatgaagtcatggaggatattaaaaatgcctaccactgtgtccctcccacctctaaggcagtgtacccactccagccacccagcccatagtgtgctatggtctacaccagatgcccccttcccactccactgtgggtgattggactgaggtgggcaatgagctcaaagagtagttcactggccttaaaggaattcatcaaatactgaactgaatcaccttgattcttttgagattttttttcactgataattgaatttttaattctacttagttttaattaattttaatttaatagccacatggagctaatggtgaccataatgtacagctcaaggctataagtttattatctggggaaagtaaaacagaagtcaaagaacattaaaaaattgagagcttttcttatggggaaaattggcacactaaagataccacggacccagagaaaggccaaaaaatatatatatgagggaaagaaatggtaatgcctggaggggcccgtgttagtagaattcaatatgaaagtattaaagagcacttctggtactataaggaatgaaatattatgaaatgcttagtgctataaaataaagacaacctgacaaagtatacttttaattttattcctgggcttgcaagaagttatgtaccacttatgcactaccaccttcacccccaacaaagacctgaacacacagcaataagtgctaagcataggtgaaaggcagggttgccctgctggcaaatgctgatgttaaaactgcaatcaaaagccagctaacaagatagagagattaagcctagggtcccagcagtgggctaaagtttctataggtgggtaaccctctggctctcaacaaaaacaaatctctctggagaaaagcttcctcaatttgggtccttagatttccgtggattaagcaacaatatatgagcactcaataaaatatgatcaatgaaatataatcaaacacacaagaaagcaaaccactataagcaagaggtagaagagatgaggtatgccagacttctacttctaagaactttaaatgttggaatgagaatatttgaaatgtataataattacaaaattcattcaaaaaatatgaagtcacagaaataggcatgcaatgctagactataaaaagtgaaatggtagatttgaaaaagacttaaacataacttttagaaatgaaaaatgttattaaaacagcagaggaaagaattagtgaagtggaaaatagagttgaagaaattaaacagaatatagcacaggaaaaaaagattataaataagaaagaaggatcaataatcattataggttccaagtaaagataatatattgaacacatacagctcattttactaccttctccaaacttattaaaactacagcaaagggattttaaacaatcatataaacccacaagaatgggcaaaatatgagatgagataccagcaacaaacttctggaaaatggaatataaatgaagaattgataacaatgttaccagagctaagaaaaccaaatcctaaactgatggtggggaaatcattgaatcaactgaatttgcactggaacacaacacaaaaagtaaaaaaaaaaaaaaaaaaaaaaaaaaaatacagtaagaggcataaattagtaggaattaaagataaaatagaagaactaccaaatcaaaaattctttaaaaagactattagattaatctttagtaagattgagaaaagtgaaggtataaatatgtatgaacaaaggaatatatctacagataggcaaaattaaattttaaaaagatttttaaaaaatttaatttaaaattaagttgaaaaaatattttaagtgccaaaagagatagcaagaataatctacactactttatgtctatacattggaaacaatttaaaatgcccagaaaaatataacttgtgaaaccaattgaagaaatggaaaacctaaatagccttataatcattaaataaattaaaatggtagtctaaaatttttctgcaaagaaaataaaagtctcaataatttcagtgacatattattattgcattaaataaaaaaccaaatgtccaagaagagccaagacattctgaggacaaacaggatgaaggaatgtgcttttctagattgcaagccttattaaaaagctaaagtaattaaaacagtatggttttgaggtaaggataatcaaattagccagtggaacagactaagaagcccccaaaaatctctgtctctctctctctctctctctctctctctctctccatatatatatgtgtgtgtatgtgtatgtatatatatgtttgtatatatatgtgtgtatatatatatatatttgctcgataaaggatattgtgttgtagatcatgagtggcttattcaataaatggtgctgagagcattagttatccatataggaaaaaaattaaagaggctccttattctcttacatacaaaaattaatttttgatggaacagaatcttaaatatggaaggcaaagtcttaaaactttttgaagaaatttagaatatttttataatcttgaaatttatttaaagaatttttttgaaagacacaagtacccattaaaaaagaaaacattggtaaatcaactacacaaatcatcaaagataccataaatgaaaacataaggaattcatatctagattaatcttgaccgtggtcttaagacttccagcctcctgaatagtaggaagtaaatgtctgttgtttaagccactccatctatagtatttttgttatagtagcctgagctaagacagctttatataagcctttggggaccatagatgaactacatcacttggttctagcatgttctgtggtttcaatgcagaaacctagagaataactaaggctgggagaaagaaggaccacactggtgggagaagctggtgacaagtggtaaggagtgggcaacctgggtactaattcttgttttttcttccccagccttgtggtcttggccaaatcaccgggcctgctgtcttttctgtagagagaagggctgctcggttctcatttggattcaacctttccaatgcagcatttaaacacggaggagggatttttttggttgtcacaaggactgggggaccctgctggctaaatatcctccaatgtgtgagacagttgcaccctaaatgccagtgtgcccctattgagaaacatcctctctataacagtcctttgaacgagccctttacatctctctacacatacatgatgtttgctggtgggtcgggaaacatttggatactttatgaagcatgcaggtctccacccaaacccacaggtcagatggctgctgtccaaactttaggatctttagggctgcagatgagatgctctgttctggtgtatgtcctgcttggggggctgcccctccttgccagaagaagatttagttgaattcaattgaagtgtactattaccaaccatttgctcccttgttctgacagccagcaggagcagaaaactggcttgctctggtactaactgcattctcagaaccgtgcatgcagtgctttatcgttctgttcaaagctaagcagtgccctccttgggacactctgggaatgtacagtattcattgctctaagaaaatgccttggccacaaggagaaaacattcgctggctgtggcttgagccaactgggtcagcgccagcctgtgcagatgtctttgtggacagagaagaagtccctctgggagaaggcagcccatgctagggtgcatagattgatgagaggagtgacaactgtatttctgtccttacttgctctcctggccaggtgctcttatgcagtgcactagctgtacaacagtacctactggctggaccctctcattctctaccaattcagcagtctcctcttggcttcattcaggaggctgtctccccatggttgcctgaacccaaaagcaaaatgtgtgggtcccacctacttctcacgctctagttctaaagaatgggcccaggtgtccagcctccacggcctgacattcaatgctgtgtacactccggttccaagttgcttttctactcactgcaccccagactctctgctaaacaggctactttagtcattgccacccaaataatgcttgtgaagttgcatctccacactctcatactcttcccttaccctcaccttttatccaactctttcaaggctcggctcattttcagtcttctgggaagccctctcaattgcccccaatcaggagttactgaaaagtgtccttgtacctcccattggtcaccgactgcacggttcatgtattgggaaccttgattgttaagaagattttaagttccttgaaggtggaaacctaatgagaagacttgcccttcaggctcctctacttaagaatcattccaagcaattaccatggaaacaaatatcttctcttcctggcctcttggaccaaaacaaacagacaaactgttaaagagcaaggaatttggctccctgcctaggttggcagtgagagcgtcagaacaaggttgaggccaaatccatgaacctcatttagttagctgcccacgaacttggcttggaacgccttggccccatcttaaagaaagcccttcattctggggacgctggtcagcctgaggcccatgctccttagtcccaccacaggaagccttctctctccatctgtcactctgagaccatattggctgaagctctgggcttactcatatcctgagtcatccaacctcgcatgtccgtaaaaatatccgtatccttataggtggaggccttatagataggttgttgagtcagatttatgagtttgagaaagagatgctttggatgcaaaggacctttggtgagtttgcagaagccctggactcaaatctaccaccactcagaacagtgaatgccagaaaattcctggaaaagggcatctctttgctgaatgaccctagtaatctactcattccccaggtaattactgagccactctgtgttccaggcacagttctagtttctggaaatatacctgagaacaaaacagacagaaattctgcccttatgagcctccacttcagctcctggccaagtctgtttttcatatgatccaagcactttggcaggtgttagggctgtaaaagggatggcatgggacccccttgggtaggggacgtggcagacacatctcttagaaatattgccgcaagcctcactgttcaagtctggtgtgtggagcagctgcatcagcacctccagggagcatgttagaaatgcatcgtctcaggcccttcccaagcccttctgagtaagaaactgcactttacaatatgctcccaggtgaactgtccgcagggaaaggcttgaaaagccttgctacaggacagcaaatcccacaagctgtcctacagtgaaagggagcagaacgataatgtgcatttgagaaagagtacatcccatgcctcagatttagaaaggtggcgtgttcaagactgagatctcctcagaaagaaacatgcttaaaaatccaatgctactcaactgtatttgatggctcaacaacaaatcaccgactgtaatcactcaacagaaccagcatcctgtgaaacacaccttgagaaaccagtagtggaccttctggcattcccggattcaactttcttggcttcaatgactgcagatggagtgagcccatggggtgataactggcagttttgctgaggaacaaatctgaatcatgcctactgccaggctgaggctctgggccaaggtctcagcttgggatagggtgaggatcagaaggctggaaagatagagggactcggagactgccagctactggttaacttgtggcataaggaggatatatacagaaaacactggattctatagctgaaatatgtcatttggagaaatttaggagccaatataagcattccttatttgtcatttcatgggctatatatattccacaggtgtcaagaatctataatgatgatgatgatggcaaagacaatgatagatacctttttaaaacttactatatgccaagcactgtcctaattcatatgttcccaacagcaatgctaagtggtataatcctcatttctgcagatgaagaaattgaggcacagagctggctcctcgttttaatccgtttcatgctaaatgtgacttctgagacctaggtgacaggcatctgactggtgcagactaaactggccagatgatggagtgaccactggtcccctttatccctcgagccagcccctgaaggctgagagacttgctcagagccccgtcccagaagtgggcaagattcatatttgtgccttagcaaaactgccagttatcatactatgggcttattccttctggaatagggtaaagcaagaacagagaaccccctctgggggtgccacttaggtgtgaagcagccctaattgggcaggtataggctggagtgacctcagtggtaggcctgggaggggacacctggtttgctctggggcagtcgtagaaggctcagcacagtgctggactgcaggtaggactaagcttggattataaggcctgggatcttctcataatgctggtctgcagccactgtgtggcctgtgacaggcctttccctgggtctcagtctttgaaaataatgatacaccccccaccacacccggtcatgggttgcaccttgggtttcaactcaatgactgcttttcaggaggtccctctggggctccttagggttatggctgctccaggctggcaaatccagatcatgcaagaggtggcttaaccctctccctctcagggacacgaagaagatctgttgcttccagattgcaccaacacacatgcctagaaccccagtaatgaagctggaacctctgctgtgtggtcagacaaacccaaggataaattgcccctgcttcttgggatgacactaggaattcgccattcttcacgaggcagtccctggggcctagagccaattcattcagtttaacattccctccctttgagacaaagtatagggtggtgataatgaagtcagtcgggcacagccttgagtgctggctgtgtgacacagggcaagtcactcaacctctctgagctccagcatgctcattggtaattggtataaatgaaagtacctatatcatgggactactgtgaggtgccagcacattatcagtgctttgtaaagagccgctattactcttgttgttgcttggacatttgttatgaggggggaatactttttaaaatttgctttttaaaaacatcaacaaatttctgaaggcattttcaaatgagactttaaaatatgtttttctcttcttataaagttaaaatttttgtatgaggttaggcataatttttttttgttttaaattaacaaatagcaatcaagggcttctaagcaattccaaggacccccttgctgctctattccactagtcttccaccctctccctcctggcagcagtcgttggcatttttgtatgtctcaccctggaggctggcaagctctgcacctcctggtcgggagcttccagctctcccctgcagctgtcctgaattcctcttgctgtaggttgtccctttgtcccagagcactcaccctaacagggaagtccctcatttcttcattaacttccaggttgctccctccccattaatgctgagctggagaagcagggttcacaggaccttacaatagggaccaggagcagcagctcggagattcaggccgcctttggcttccttgaccctcctgtacccagggccagcatcagggagggaggaagaggacagggacaacaatcagcagggcccgtgtaagcatacacttcttatggatgactcctctgacaaccacacggggtaaggccaggctcacggtcacacagtggctgagccagaagatcagtgtttttgcttttccatctaataatggctccgtctatacaaaattttgggcaggaagggcaatgcatctatcagaactcattggtgacaggcgcagcaggagctaaattggctgagttgaaccaggctgttacttcctagctgtgtgaccttagggaaatcacccaagctctctgtgccaacaattgtgcctacctcataggattcatttaaggattaaagaagttgataaatatcaagtgattaaaatcctacctggcacatccatagcagggattctacatgctagatattttaattgttgttaagcctcatgaaggcaggagtctttgtctatgttggttattggtctgtgttagaacagtgcctggtacttaataggggctctataaacagttgttgggtgaatgaatctatttctttcaagataaaaactcttttgcaatgcagccattgtttatcttggccagcagagggcagcaaatagctgtggactgattaattgtggacaagggtggttttaattttgaaggctaacagaactgtccctcctgagccagttagggaaataaaaggttgccatgaacctgtacgactggccccgacccctcccactcacctttgtgcaggttagaatgattgtcaggcattcaactcacaaaaaatcttggttccatttcttctcaacttactttcaatttccttcctccctccctccctctatccctgcttttcctcctttctccgttttctctaatcatatttccccctgcccccacactcactcctctgcatcaagctagtatactgtacacactcccaaactttatctgtacaattgcagcttgtactgcaaaccatgacatctagagtggatccttatacagtattcttcccaaccaatgaatgctgctaaacctagtataattttttaaacaacatgtaatttgataactagacccagagaggtactatagcttggccaagaacacacagcaattaggggtaacgttagagccctagccaaggccttctgctgtccattatacagcctcatcacacatgttctcttttgccaacaggaggctcgtgtggtccctgtttgtcatccagtcaatacggccatcagcttctggccccagacacctttcctctgcactgtggcacagaggagcagactgctttggagggcagcttcctgggagctccagggaccctggccaggcggccactgccactgacttcctcggctcactgagcccgtgcctgcagctctcgtgtttcctctgtgctgcagtggacgcttatcttcccccgatggcacatttctttgtcacagacaggaccctcactggcagtcggaggtgagttcccggggagcttctgggtcttgttggtgccttctggcaccacttgtggatgggatggctctgacacccaagcctcaccactgctccgggggtaacccaatgacatgatctccccagcttgctagatcctgtccttcccaattatgatccaaaaaatcatgctaggataactgtctggaaaaaatatttaattggtcttccagctgggaaacaaattctatatgaattgatgagaaaaaaaaaacagaatttttaaaactagaaaaaatgtgggtgacctattatcttaggggatatttctttaagcatgaaagcaaaactagaaactataaaagaaaaaatgtacaggttgactacatagaaaaaagctctatatcctggtaaacatccaaatcaaaataaaagctagtgacaaatggagaaaagttgagctacccgtgtaacagacaaaagataaatatactaaatcagactctcaagaaaatggataaagaatctgaactgacaacctaaaaatatcaagtcataggaacatgaaacatgctcagtgttactggtaatgaagtaaatgcaaaattcaatttctgcatcttgaagttgcaaatttcaaaactacgtagtgtcagtgaggatgcgggccacagcctctctcattctgctgttggcacagttctggagggctctgtatgcttacaggtgtccatgataaatgcttttctgtgtagccttcatcgctatcaccttactatctattgcctcctccctcccgccttcctttaccacaccaatatacttcacaatgatagggatattgtttactgatctgccccaaatgcttacaatagcacctggcccggctggttgtggtggctcacgcctgtaatcccaacactttgggaagccaagacgggcaaatcacaaggtcaggagttcgagaccagcctggccaacatggtgaaaccccatctctactaaaaatacaaaaaattagctgggcgtggtggcagatgcctgtaatcccaggctactcaggaggctaaggcaggagaatcactttgaacccaggaggtggagattgtagtgagccgagatcacgccactgcattccagcctgggtgacgagcaagactctgtctcaaaaaaaaaaaaaaaaaaaaaaaaaaagcacctggcccaatattagatgttcaacatatgcttattgaatgaataattgatctttaacccagtagttcttaggaattgatactaaggcaacaatcagtgatgtacaaaaaagatttatatccaaggatgctcatttcaacatatattgtaatagtcaaactttgcaaaccactgaaatgtccagtaaaaattatgaaccatcctttttagagactataatagtaaagtcatgaaaatcatgttatagaagacaacacaataacatagaaagatttcctagatatattttgaaaagggcaggttatataactgtccagaaatttattttctatgtataatacaatcttaatgtatataaatctacacatatatgcatggaaaaacttgtgtaagaacatactgacattttaacagtatttatctttggatagagtaattgtaaaatgtttacatgtttttctttactctttcatgtatttttgcagagtttctgtgataggaccattttgtttttgagactggattaaaaacaatgtagcagaggccatgggtgcctcacccatattcctcaagctggccctagttccaagtagctaagagcctggcggtggccctctacctacaaaggatgggagtggagtggctctctctcacagcttcctcagccccaggggacaactctgcagcatgttcctcacagcttgacagaggccctggccgtgcaccttggtggctgttctttgcattcccttcttctcagccttgcttctccatgccacctcagtgcttcctggaatcacctttcaagccagctacttgcacacaaatccttgtcccagagtctgcttttaggaggagcccaggctaaaaggcacaaacgctgttttaaaaatcctgcccactccgtgtaaagaacatcagccaagcatggtgctatagaaataactcctatcttggctgttcctgtgtgtagttcactttcaatctctcagcatccctgagttgaagagagatcttgcttaactgggagggaaggccaaggggtttctggatacaggagccaccttggggatcttagagcctcagaagaggcaaggatgtacgttataagaaggggctgtccagatgataaatgaaattaataaaccacccctgtgatgccagcacatggctcacagcagatctgcatcaggcgcctaccattgccctaggatgccattaacacctactcttccttatgaggcttagaatcagggctgctgaggacttcagaaatcatctcattcaggtggggtgaagggggtgggtagcttccctgagggtcccacagcaagagttagagacacagccaggaccagaacttactgaaaagcaataatccaaggtctgacttgggttctgaggatttgctcagttatagatgtcattctcgatttggcctgaagagggcagacacttgccattcatggaggtgaagagcttgtttttaaggctggactaacatctcccaataaggtcatttggttctagtgagagttgcagctcacaacattcttgactcttctgctgcaaatatgctactggaaagacactgaagttcacagactgaagttcctttagttccaactctggcactgtaataggtgaccttgcacaggtcacttcacctctctgagtctcacttcttgtgaagtaagatctctactccgtgactgagaaggtggtattggggagtgatatgtaacttacaaagttgcatattacaacacacatcactgctgttaagttctgtgtgtgtgtgtgtgtgtgtgtgcgcgcgcgcacatgtgcacactcgtgatggagagagcttgataaaggagagaggcctaggccaaaggagctttttctggcctcaggtgaatatatatttgtaaattctctagcaattggaaccaattcactttgtacttggaaaagacttaactgcttttactttatatttcgaactgtacttttttaaaagctaaagatgtcccttaacctaactggtgtatgggaaaaaatatacataacagggatatatgtaaagttctaccattaagtcaaaaatattgctgaatacagagaaggtattggtaatacaaatttttaaaactaagtatttagtggttgcttggtcatgagaagcaaaaaagtaagaagtgagtatttttaaaaatcctgtaccattttcctaggacatcaagccctagtacaggaagggacattttcacactaatctgtgccagctggagcagtcctgccatctgaacatcatattttggaaccctgagaagctaggatgcagttaacaggtaagtagtaatgggagaactttctagaaaccatgtctggaggaggggttcaggagctgagatgctgagcctggggtagggaagacttgagtggggcaggccctacaaaaaggggttccatcaatccaaataaggaaaagtcacaaaggaaaggtctggtctcaatagtgaagggcattgttccctgagagatcagtgtgttgtcacaggagacaggaagctctgaacacttcaagacatgcttagaaggccccccgatgtcagcagaaaaggggctgctaatgtcatctcagaaaccaagttatccccatgcaacaaaatcaatcacgtatcaaaacatgatggagagacagcctgcagaagtcagatggttcccggagcactacaggataaaaaggaccttgaaatacagaagacaaagtacaggctcatgaatgtctggacacaccagcaaattgagcctgaccaactgcactgacatcctgatgagtcagcttgaatcaagaagatgggtcccaaataactcagggtcacgcagcagagagagatggggattagtcaagtgtgttcactctctcaccgactcttcctgattgaattcccacactatgctaggcactttttagggagctgtgtatattttctttggaggcacagggttaggccattatctcttccaaggacagcagtttctctgtgaatttattccttgtccaccaaaaaccttctatttcctcttttagcctccatggttacctgaaaataggaaggaaggaagtctacgatgatggagccataagatatatgcattctttactgtaaaagatcacacagaaattctagtttatagattccccaatgttaccattcagcctttggaagcctgattcaatttgaaagagtagataaaatatagtttctagaactgacaaggtgaggatgagacccaagaccagggtgtggccactaccatgtgaacactgggaggtcctccaacctcccctgacatttctcttgaacttctcaaagttacctgcttggaccccaggggtatgagttccaagggcccgatcagctatgagattataggctgaactcaggcatcagaattgttagagctttatctcagttctgagaaatggttaaaaccacccttgggcagtcacacgtggaatcacttatttcattactatggacattttcttgtaggaacaatacatagtgaaaatccactgggataaccaacataaaactgattttgttttcagtttgatatagcaattgcattttatttgtttgttgtaagtattggtaaactttcttattttttaaaaacagacatctgtaaaattatatacttttttcctataatatcctttaaagctgcttgaaaaatgtttattatgacaatgtataaaactggtatacatggccaataataaattttttctctaggttgatggtccttactaaaagcattttctcacctcttgagtttccacttctctttccactgattgaaatgggttgcatccaacctgcattcttgaaatggagacttctttagtgaaactccaacacccactacacatcggtggagaaggcagaacagccaggggacatactgcaacccctctcctctggacctcaagtttctcctccactgtctatttgttatttctctcctgtctcaggatgaaagtgtcttttcactccttcgatgctaactcatcaacttgtactcttggtcccaaaactctgatttggcttgtggcttacattagctcctcaacatctttccttcatggctggatctcacccttcaggtttacaaacttagttcacttccctgcggactaaaaaacacaagtctccattttactctggctcttctcggagcaaccattttacctccttccttcccaccacaattgcccactgactctgctacacttctctgtctaccttctgcccttgccacttaagaaggttacacacatccaaaccaccaaatccaagagacttggatccttaaatgctgctgaacctctgaggacatctaacgttgtttctttcgtcttttttccttatgaatctggttctttctttgaaaccccacatttctctgatttatccaccttatcttcttcccctttcctatagaatatggccatgtctggctcaccactcttggtggtcatctgcttgatgttttactgctctgcccagttgtccttcttcctctcaatggtggtggctgcccaatctgctggacccctcagttctaattgttagctcatttcctcaaagagatggcttttaaaacctagcccaggcaaacccaaactcatcatcttgcccactgtgctagatcttttctgattgtttgcccaattcaaaatggattctccattctttggagatggacaccgatctataaggtaggccccaagcagccatttgacctgacttcctggtcacaggtgactggcacagggacagccacctgcctaagactcctgtttttaagtgagagaaacaagaactggataaagactcagtagtgaatggtactgctctgagagaaaggtgcatggattcctggtgctaggggcccttagagctgccccacttcccatcttcctggttaattcaactcttccatggatctctcatatatgctaggaaagttctagtacagtctgtctcttagctaagcttgctagagttggctcctacttagaaaactttaagtagtgaatccactgacatttgtcatccaagaatctctctctctgtccgaaaccccacccattcccttccccagcgagggcttgaaatttgactctgatcgatctttctgtgcaacccacatccagaacattcaaaccttgtgcattttatctccaaaataatcctctcctccaagtcctctgctactgtcctggttccagtctctgtgatctcttttctgggcttgtccagcctctccaggctccagtgatcattctgatcgtatcacttttctgcctaatatctgaggctaagtcttgtaactcttaccacagcattaaaaacccttctccatctggctcacaggtgcacagggctcatcatctgctatttccattcctatgtgccagccaggcctgatcgccgaccttatccaaacattgtccatgctttgcatctttcttctatgatttttgtactgctgatccctttgcccgttggctctggtaaaatctttctcctttaaggtctatctaaagtccttttcctaacccaggggatagagaaacgttccctctatcttctgggacaggagttccctgctggactgggaggcacggctccctttgattcctggcactgcagtggttgattggtaagtggatattgagtgcacaggatcgtacaccatcccaatgtccaccaggttaggaaaaggcctagagagaatagccaaagtcaaagcattttctactgtcactgcttaccacgctttaagccaaagtcaggaaaaggcaggctaggggtgctgagtggtgaattacatggactgtgccccagacctccagacctcagtgtctgaaaaacaagttactcatgaaactggttttagactccaggaaaaacacatttatgtggcttgctgttcataaaacacttccatatatatgaactgattgaaattttcactgtgaccccagtaagcagttaaagtttatcgatataagtgaggaaatagccaggtcagatgtaaatcacagaccttcaacaggaaacagtgttccttctctcggctatctccagtgcaagtgttaaaatacaacgaaaaaggctattggggaaagtctgaatagggcagaggacggctctgcttctaaagcacgtgatgttctccccacctttgttgtcacgcatatgagcatcccttgccagcctagggaggctaaccacacaggacagaaaatgtcactctttctccaggaataggtattatccccaaacactttgatttgatgataaagtatatcagtttttcagaaacctatttcccccatcaactccccacctctaggttcaacctggaaaataatctgcacgcatgtgtatgagttttagcaggaggggatatgcatgtacacatatgcatatacatacaggtttatttaaatgattggatctacacttttggaggctatttgaagtatcttatcaaaataaaacgcattttaagcaagaagttaaaaaagcttttcagacccgaaggccatttaatacagtaaatcttacttgggtagtttagcaaacattttttaaaacccacatccaacagattggttagtattagatacacagatttggtttcaaagctgaaatacccctggtggaataaatcttctcatgaaattcagttatattatgccacaaaacagggacacttatctattgacaacttaaatattaactcagtgggctacctggtgatataaataggaaaaaaacagtggtcatggattaggagtgagaagactatgacaccagcctaccttggactgggaccgcaaaggatgttaaaatctatcctagaatttaaaacaggaaaaatgtcaaatattccactccccattcggcccaaaccatcccccaaggaatacacccccaccccacccccacatgaggtttactaaccagctgctacagatgttactatgtcactaattaacaatgatcacagaaaatgtgtcataccagagtttttgttatcatacacaatgcattagtggctgcaggaatcttcctccaaaagctaccgtcagaaggcaaactgacaaatgtccatgccgctggtccaagaaaccacagctaagagccatgaggcattcatttgtacattgagctctctctggcatgctccccactctagttagaggggctggggtatggagagaccgtcccagccgggcgctgcagcctcctactcctgggcctccttgcgggtcaacttgtagatctcagtgggtccgtccacatgggtgatagtggtggtgagctggagttcttccccactatggacacccagatcgcctgaaacagggttttcggtgttagatgcattcaaggaggaaggagaagcaagctggggttcatctcatggacaactgccctgatgctagccctctttgacattctgagcacacagagacacctagggcacacaacattcagaacaaggactaactccaaacctgttcacttggactttgcagaactttttaaaataccatttttggctcctagatgacagtcattaagatacgtgagtcagctcactgctgatattattcatagtaatcattaacatttaatgagcatttactttgtgcctgacgctattctaatcactttgtaagtgatcttctttaatcctcgcagaagccctctgaagtaggcagtatgaacgtgccagccttacagatgaggaagctgggaggtaggcaaggtaattgtcctgggtggaggagcaggcccacaagagagctggcaaaggaacatctgatgccaagaccaatgtgatgggctaaaccagcataacacccctcccaacggatgggtcagtcaggcaccaacacatttgctatgaataatttacaaaataggagccaggtgcagtggctcaggcctgcaatctcagctactcgagaagcaggggtaggaggactgcttgtggccaggagtttaagatcagccttggcaacagagcgagaccctgactctaaaaaaaaaatttgttttaattacctgcgtgcagtaactcacacttgtaacctcagctactcaggaggctgaggcaggaggatcactggagcacaggaattctaggctgcagtgagctatgattgcaccactcactccagcctgggtgacagagtaagactttgactctaaaaaaataaaaaaataaactacaaagcatctatgtcacgtgaaagcaaataagacctgcttatatctatccatagattggggaaggagccatgtctaacacatctaggaacaatgaggggctttattctccaggaaaaaagaagtgccagaaacgtgctgtgcatttccttctgccctcaggattgtcctaagtgttctgaactcattatcagtggacagtgttctgctaaaatggaataatttgaacttttctaaattagtaggagaaaaaaattttctctaagttaaacctcgaaaactctgctacctgccataagacaagtgaatgtataaacaacaaagggaaaatggaaaacgcaaccacgctcagtctgactgtgtgtgggggtgcacgtgtgcacacatgtttgtggagaggggtgctggggaatagaaagttaaacttgtgtcagtgatttttatattgtgcacatatcatatgataagttttctggaactgaagtttttctaatttaaagcatagaattaagtaactaaatgctgttttccattgaaatgccataccataacttagaagcagccttggccctacccttaggactagtaatcttatcactaatttaagaactgctaggcatcaatgaatctggtggccttagaaccccagatgtcactcccacccactggcccagcaggctgcttggctggttcccttcacgtgtgccacgcagtattagtttctcatcgtagacccatttctctgtggctgcacagcaaaatcagtcctattattaaatgccaccctgtaagctctctacccaggagattccctggcctcagaagcagactcattggctgctgcagaggactgctgaagacatttggggctgttttggcaagggtctaatccacaggactatgggtagagaaggcattaaaggggcatcagtccagcctccagcacatccacattcatctgccctcaagccagagcatagatgccaagtaaggctggtgagaggctttagctgggctactttgggccaagctgaaccaccacttgtacagtgagcaactactcccaggccaataacttgtattctcactgctgcaacatctagtccacacctcagtcaagcacaagcagtctaagcttcacatttctcagtcaaagctatttctggatttgcatatctgggctagccatcagaacttcaaagccagtttcatgatctgcatgtctgtgtgagtcatcaaaatttcaaagagtcctgaccaccccagtggacccattagcactcataaccgtttacctaaggaatccctttccctgaggacttcttagaaatagatgctagagagtaattctactcaggctttgaaccaaagatgttaattctttaaacttaaaatatgactccaattagcagatcttagaatatgcatatgatcctacagatcacttgaaaaaacagccaaaattgccttggcttctttatttaaatggatacctatgtcataatgcttaacacgtgcctgacacagttctaaatactgtacaaatattaatgcacttaattctcatagcagtcctcagaggcactattatcatcactcccattctgccgatgaagaaactgaggcacagagaggctaagtaacttgcccaaggcccaagctgctaaatagtgtgtgggattcaaataaataggtgccaggatgcaggctctcaacttttgggttctgctgcctcttcttaaatattcaagtttccagcagccagtgagactgccagtgaggtatgaagtccacacacacagcattacagctaaaaatatccgcatacagccgggtgcggtggctcacatctgtaatcccggcactttgggaggctgacggcggcggatcacttgaggtcaggagtttgaaccagcctggtcaacatggcaaaaccctgtctctactaaaattaaaaaaattaaccgggtgtggtggcgcatgcctgtaagtcccagctactcagtaggctcaggcagaagaatggtttgaacccggaaggcggaggttgcattaagtcaagatcgtgcccttgcactccagcctgggtgagagagtgtctcaaaaactaaacaaaacaaaaaactacacataaaataatttgaataaattgtttagcatatttactttgcttttgtatctgataaatttatagcatataaatcagtgcactgacaggagagctgttataaatttatgagtattggccatatgcactgttaggggtttagcatgccctgtatttccttgtacgatgtgaagctactgtggcataattaatttctctactgtgctggatgaggacccagataatgggactccatgcaccaaaatctatgtttcacatgtgattttattgtaccttgaaggccaactgttcccccttggggaatgggtgtgtgaacgtggcagtaacatagcacgagtggagatccctccacttgcctcctaattccatcacctcctacttctgccaaggtcttgctccatctgttagtttccccctctcttggctcctgctgttcagtgcacaaacatgctcaaaagtctcttcccatctcagacaagaaaaaacccttctgaaaatgtgatatgtgtcttggggtgaaaaagagtgagaaagaaaaaagaaaagaatgctttagtttgcagtaaatttctctccctggttatgatgtcaaattcatcacagctcattaacaattagatgacggtctatttcttcctaaccttgtgaaatgagaccaatctctggcacagatttcatcccaaaggactacggcaatgcatccatatgtgtggagtcacatccacaggtgtgtaagcggctgcttggttgtaactgcctggaatgcctaatgaggatgaagaaagccatatgcactggagacagcttcttaggaccggcagcattttaatgacaattgtttgtgtatctgtgcccacttcaataaaaatgacaacagctactctcattctgaggatgtattacagattccgggagagatcggaggtaccactagaggtcttctaatattaataaggcctacgtacttccatcctcaccactaccaatgcaaattaacaccccactgcccaagtgtgaaagccagggagctcccataccatgagttcatatttgttctcaaggtcatacacaatgtgtgccggagccaagattccaaaccatctgtgtctacctccaaagcttatgttctttccagaacattcatgacctatccttttttgtagaattttccctaggcccacaccaacctctctcctattcaccttcaaagctaagttcaaatgataactttttgtaacgaagtctctggttcacagcagaatgagaaaaacagaaaagtgtagtattttaaagccaaattattttcatgcaaagaactgcttaagaatatgtctgccttacatttttggtgttaatatgattgttatgttaaagaacaaaatagtgtcgctggtgcagtggcttacatctgtaatcccagcactttgggagacagaggcaggaggaccacttgagcccaggagctggagaccagcctgggcaacatagaaagatcttaaccaaaagaaaaaataataataaaatggtgaatggtaggtttcttcttctttttttttttttttttttttttagatggagtcttgctctgtcacccaggctggagtggagtggagcgatctcagcactgcaacctccgcctccagggttcaaagagattctcctgcctcagtttcctgagcagctgggactacaggcgcatgccaccatgcccagctaattttgtgtgtgtgtgtgtgtgtgtgtgtttttaagtagagacagggtttcaccgcattagccaggatggtctcgatctcctgaccttgtgatccacctgccttggactcccaaagtgctgggattacaggcgtgagccaccgcacctggccttttttttttttccaaagaaagtaaatacccaggacagtatgtggtatatagtaagtgctcaaaacacccatgaaagatttgcctggtgcaggcaagggcagttcctctgtactctgcatggctgggtctagcctagcatatcggcactggtgttcttccccactggcatttaggaaaacaccctcagttagaaaacaagtgtgccttgggatagctcagctttgaggatcccttctgggagatggggcagagtggctttggtggacagggttaagagccctgggtccagttgtctctcggtgcctgtcaaccccagaggtcatttattccaggcttggagcgagccattgcccatggacctccaaagcacctcctgacacttactgccaggcagtaactgcaagtgggagaagaacacaatagaacttattagtttgggggtaaaatcttggtgttacaggctgaattgtatctcccccaaactctcaaattcatatattgaagttctaacccctagaacctcagaatgtgactgtgtttagagatagggccttcttaaagaagtaattaagttaacaatgaggtcaattggggatgggccctactccaacagactggtgtcctttgaaagaaaaggagattagaatatagatatacacaaagggaagaccacgtgaagacacagggagaaagtatccatctacaagccagacagagaggtctcggaagaaacccacgttggtgataccttaatatcagactgtgagaaaacaagcttctgttgtttaggacaccctgtctgtagtattcgtatagcaactctagcaaacatttaggaagccgaaggttcttcccaagaaggtaactgagatgtccctatcatggtggggtgacaagaattctaagactcagaaaaaatgattttaattgactgggccaggaaaggtcaggtcactggcacagcaatagccctgggagaggcagggggcagaagacacctgattacaaacagctgagcaaggggtgccaggctggtgacggtccatcagttggttcccaccttcactggggaatgggaaaacgcttttaagacctgctttagggtctgggtccagcccgtgtgacaagaccaatcccatcagtgctcacagacatcaagaagctcagctggccatgggcagatcatctaatgtacaatcagggagatggcgtcaataaaagggggcaaccaatgtcagggcctcaggacttaatccaacgctttaccgaggcaacaaagccaaagccatctttcctatgaaacaaggggcaggagacctcagaaacctccaggagtaaaactgacatcacactgtagctagctgccaagacgcggaaccagtgttgccgcttttgctccccgcagagtgggtgcattagacagaaaatgcttagcgtgaacagaaataggagggaatggtggcagtgagggcatcttgtgttccctctgccacagtcatctagttgggaattctgtgtctcacttctttttttaaaacattctgacaagaattttataatcaaaagaacacaaaaatcaaagctattatcaagaattgtctgacttcataagcagctccaacttcttattcccacctgaattgtggttgagtgggtttgcacagtttttcatgtgtgcagggctttgctgctggagccccgggaggtggtatttttgctctgagaagaggattcactttagcctgctgcaattcatatctgcctgggaagacatccagaatgattcacaaattggttatggcaacaggtaaaaagaacaactgtcatgaaaaggcagcagcagcaacagcaacagcagcagcagcagcagcagggcagaaaatataagtgttccttgaaggaaaggtaactaaaatatctttgctaaatttaaaaatctatatgtgcacgtgtgtgtgtgtacactcagacacatatgcataaaatgattacacatataattctatgtacataaaaataaaatgattaatgtgaatgagtttgcacattcactgccgctatggtccaccagccaataggaaggaacccaggggaagtccacgaaagcctgtggctataaagaatgtggcgccacactcccgcagcacctatctgctggtgagaacactccagtgtggagttgtcctgccacctttcaagaggtagatgaggaaatcttgtcccccagaccaggctaaagaccccttgagagcaaggactatgtctctgtcactccttcgagcttcacttcactccatctcattcaagatggcacaaggctaagtactaaggaactaaggtatgaggtatgagctaagtactgaggtgctccgtggttcatttgtaaagggtcactttctgatccatactatgaaagagaaacagaaatatatgagaaaatgctctttggaaagtgaccttgtcttgaacctgtggcccactttgttcttctctgtccattctatgaccaaaagagagaagaaaaagtctatcgtgaaatgctcaatgattccatttccttcctacccacttctacttcctcctgacacttggcatgtccctccaactcacataccaaacaacctccatcaaagattctttcccttttcttattgcctttggcatcagaaactgcttgtctgtgctccgtccaggatccatctaacaaaggctgaagccccacacacctgggattcactctctgtagcaagatatctgaattcctagctctgaagcttcaaagcaaaggagagaaagaaatagggagggaaaggccaaagccaacttaaagacttcccatgagaatggaaaaggagcatgggaatgctggaggtggagagagaatgccatccagagactcagagaatgtaaagacacatgtatccttccttgcaagagttcttctttgaggtttccacataatattccaaactaggtctttccaaggaacttcgaaatcttggcaaatgctccgtaattcctaggatacatcgtgtgatctggtggcagatgaagagatgaaaagtgaaacaaaatagagaagaaaaataagcagaatgcccaacatggaagagaccccttccaaatgcacaaggtcacagcaccatgcaggaaagggaagggcccacaagctgccaggggttcccgggggtgctgggaaatcacagatcatgttaccaaaggagaactgctaaatcttatgacttttgtgtttaggatcagcatatggtccccaaatagtttgcccactaaattgcctgaagaatgttttttcacagagggtctacttggcatttcacaggcaggacatttctttatgacatgagccttgttttgcctattgaacaacatttagtagcacccctagaatctggacactaaatgccaaaggcatgtcccagttatagtcacaaaccaaaacaactgtgaacatttaaaaacacccacttagcagaggattcaggggatatgacctcttgttgagaattatttgcaagttttccatgaaattacagatcaagctgtctttgatgaaaaactctgttgaggaagagtgaagtgcttttctcaattgcaacatttcaagcctaggagactggctactgtgtagggtgggaagtcctgatgggagctgcctaatatatggctcaaatctcaagaatctgtccaacatggtggtctgtagtcatcctgcctctgcagggttggccacagctctgggctcccacttgctgaacagtgttaaagttggacacgttctcaccagtgtttggaaatcccttacctatgacagatatcactctctgggctgccacttagtggcaagaagtgttcttctgccccttccctgctaataggaagaaagacaaccatggactttcttttcttttcttttcttttcttttgagacagggcctcctctatctatcacccaggttagagtacagtggtacaatcatggcttactgcagcctcaaactccttgggctcaagggatccttctgcctcagcctcctgaatatctgggactacaggtgcacaccaccatgcctggctttttttttttttttttttttttttgtagagatggggtttcactatgttgcctaggctggtctcaaacttctgggctcaagcaatcctccagccttggcctcccaaagtgctaggactataggtgtgagccattgcacccaggctaaccacagaaattcgtagttcaaaaggacttttaggagatcacttacatttgggagcagtggtgcacagagggttaagtgttttgccaacagtcacacagtaaaaacaaccaaaagaatttatgtacataaagtgctgtagcacacagtcagtacttgataattatttcccaccggtattatcattccatcatccaggaagtccagccattgctttaagtggtatttctctggaaggtagaaactctacctactcacatcaaggacaaggccacatggtttccttcagtgtcccccacaggatgaccatggaatgaaatcaagattcttgtccacaagcccagcagtgcttgctgctcgtgttgtggaagcccactgcttgacaggctgaatgctcccattttccacatgtacagtaaaaacaccgagtggtgtttttactagaaatggaaaggaagaaggctgcctagctcacaagccttctagcaaaacagtcagtcaaaccaaagttgggcagggggtaggtaagtaaatattctgtattctcacctcagaccagagatgggcttgaaactgattgtaacatgtctactccaaagaggtcaaggggtgagggaaactcatgtccagcatgctctcgcatggacatggcaaatacaggatgaagacagacagtggctgagaccactccacgtcccttgacccccagcacagatgccttcctctcctgctccacttcatctcatctctcaagtaactacccccctcccttctccccacaagatcactgaaggctaatctagaactcttacttctaagcattaattcactcaatattttaaaagtatcctaaagaactggtccttgccctgaaggagtcgatgatccagcaggagcataaaggcacagatgactcatcttccacctctacacaataaatgtcatgtggaaagtagactcatgatcccctaggcatattccttaggacaacagtttcaagagatacactgcctaaagaaagggtgccagggccaaatgatctaataattctggaaaatgctgttaccaccccccgctttgtaaagactgacagtacaaattaatgtactaaaggcattaacatgtattgcagtgaaaagccttattagtgctgatcaactcaatcattctcaagcatgtttgactacctaaatttatcaacatttcatggagacaatattccattgaatgtcatttgctggattctaattggggtgattgggaataggtgttaaagaagatgctgcattttgactgggcccaaaagatgagtagagtttcattagtcccagatggaggcagaatgtgcaatccactcatgcaacacacactcactgagtacttcctaaaggtgaggccaacccttggctctggggggctgctaccctggtttccactgcaaggcagagtgaaaggcactagagcactgatttgagaaagggcttcctatgtttggggaatagcaaatgcatggctagagtaaagcaggtgtaaaaagagacagaatgaggaataaggctgaaccaaacagaaaaagcatctattagatcagttgtttatcaggccacctgttacctgttaacagcactggcctagacagtgttaatcatttctgtctgctgtggctagtgaagaaaccctgagcaagatcttcccttctctaggcctcagtttctttatctataaaatgactggattctctaaggctacttgcagcatccatgtctcagtgttctgtgattataagatataaaaaggcagcagcacataccagcactaaaggacaggaagaactggggacaggagaatagctattggtttagacatacatcgaaaaatcaccttgaagaaaaatgagcagaagaaaaatgaagcctattccatcttcagctctcagggcccagactccctccacctgatatcttaggattctgcttctcaaatgggaagaataaacatggcatagtttccaacagtcaattgtgctcaaaaatgtaaagaagaaaatttgactcttgttctaaaatcaagacatattttagacttagcatgcaatattctcaatgtattttagagatttaaaaatgaggacttaaagaaagatctggcttgtgtgggctttttgtcttatgggtgagtcccctgggtgctcattcaccgtctcccagtgtgaggagtatacttggagggaaagtttcactgggcatctcagagctttagccatttaaatcttgtaaagacagaagcctatttatcctgacttaagctgttctaaagagacagaaactcaccattggactggtcttctccatagtttttatgggatggtgcatacaagaacatcagagcaaagacatacagattccacatcccatagatgcctgtgaaaaaggcactgttcacttggactgtgacgccgccccatttccaatggccttccgttacctgcggagaaaggatggtgatattcaattgaaacagagaagaaacagaagaaacataacaccaataaaggaaccaaccaacatgaaaaccaagtctcttctacatgtgggaaacatgaagggccatgtaagactccatcttttaatctgaatcatttcggtgtaaattaaggtcaactgaaggttctctagctttctgtcaggcacagtcagtggtccttaccttgcccacagattagtatcacctggggagtgtctcttcctaaaaacagcaattcattgctatccctaagttaaacaaactgtgtttgagcccatcacttattcacaattataattcctcctctgctgtctgtcttcccagctagatgtcaattccctgcaggcagagaccagttctctgctgccatgtctttaaggcctgatgcaccatagattaattcaaatccagtgtctaccactcactcggcttaatgtaagacaagatgaagactccagacttcagaacttcagtgtccgtaagtgtaacataaaagcttgcaggttatcgaagagaattaagtaaaaatatttctagaacctgcctggcaggtactcagtaaatattagttatttctataacatcccttgaagtaagccactcatgaaaataattatgaagctttcatatgcttcaaaattctgcaagagatgttttgaagctgcttttgtctgtgttaatgatttggtaattgtcttaagggctgcctaaagatatatggattacactaagaactgtcaacagagctgctgagctaagtgactaatttgtgccagctctgagacaaatgaaatgattttgaccacttctgcttactacgggacacttaaaatggaaatagaagaaagtattgggtaaatattcctttgacagctgaatgaggctgcgttgtataaactttctctaggaatcacttttaaattgtaagatggcaggctagattgaaatgttaagaactttaacaagcaggtggatttcattgcctgtttatgatacagtgggtctgtgttcattatcttctgtataatccataacccacttggggccctaggccaaattaaggtctaagtataggtatttttttctgaaagaccaggagtgtcagttaaccacattagccaattatagacttagcagttttagtttggccttggtgatacataattcttcactttttgtgactcataaacaaaccactattatgaactcttatttattttggaaaataatgcattttatataaaatgcccagaagtgttttctggcaaagatggatttcataaccattactaattttaggacaatgtaccagcattcaagctacttaggacttcttagaaatgtctccaaatgtcgctcttctttaagtgcagaatatactaactttataaaaactatattacttagagcatcttatgatgatttttattgcatataatggaaaggaaaagaaagcattaagatagtttccagaaatacaggtacctgctgtcataacacagagaactcttctgtatgtgattaaggaggggaggctaggctgtcacgcatcctagctgcaagagagaatatggcaatatggcagctcttctactctgttaaggcagtggacccttcagctcagggaagggccagtaagagaccctattcctgcgacagaagctggaaatactcaatattgacaattttagtgacattgattcttgctaggattgacatgactgacccatctaaggaaacaccaacctatgtgccttgcacacagtggtgctcgatagacatatgttgaatgaacagaggtaaagtacaggtatgtgtagggactccaggacaaatacatggaggtagaaagtggagatggaaagaaccactcttaaaagtacttgattgaaaagtaaagacaaagtattgcagtccacaagtcataataattgaatttaaaagtgagaggagatgccaatgtgtgacaagtgttattcatttaaaacattgctttccgttatacttatttaaaataagtggttaacacaaatattagcaaagctaagattcttttgtattcataacaaggataagcatatttattcaatgctaatgatgtgccagatacaatactaaatccttttacatgaaacacattatttagtcttattaatgacgctgtgaggtaggtaggtaatatttccattcaacacatgggtaaactgtggcacagaaagatggagtatcttgcccaagattgctcagccagaaagccatggctctgactccaaaagaaggtattcttaaccattatacaacacaagggtaggaatgctatcttaaacaggggttgatctctgaaggtagcacatgctctgaaggtagcacatgaggcaacgactatgtaaggtcaaatttccttttgaaattcacttcattgcccataatgtacattacaaatacaacatacatgcacacatttgtctattcaaatctgtatagtatgcactatatatcctggacatagtaacatatggtataaactggatatataaacaaaataaaaacttacagtagaaccactggaatgagatgcccatagtatgagaggcacacaccaagcctgacaggaaatatcagactcatgctcccgtctcgtacttgctctgggacacatgcacattgtttagagtggagttgcagaattacacaccctactgaatgtgcaatctgtaaatgtggtgtttcctgctgtgggcaaagagttgaactgcagaaataaacggtatagatagtgtaactctgctctttggtggctggcttgtttttccctctcctctcccaattattcatgcctaagacatcctcagctctgagcacattcccaccaatatgtaccacaatgagcagcctcaacagagcaggccttgtaaatccaaaatcttactaatgccaaggcggaggtaacagtctccccccttttaactttgagagaaaaatcaggtagccccagcccccctccgccaaaccctcccccctcctcaaaatccccaaatctcaccctctgcataagtcttatttctaaaagtccctgtttttcctgattttacatttgaacaatttacttttgtgtgaaaccacccaattatacccctggagccaagtgaaggtcaaatctctttacacccagtagtcttgacaaccaacattccacttaacaacaagatttccaaatcccagacacaggctctcttaccggaaacatttcctctgtaagtaacagaatgaagtgatcacacacacacaaaagagctggggacaggctctctgggagtttgctgcatgtggcttgacctgaatgtcaggcacctgggggtccccttaatgaaggtcggtgaccttctcccctgcactgcacttctgttccctactgccgccacctctaaatggaacgcctctttcttttccagagggaaggggctgaaataccagactgcgatgtaccatctcttggttgctatgactgaggccattaaaatggcaggcattaaaagactgcacctcagtacccagctacaaagcctcaaggtcactgcattccacagcttcccgtcgcctttcattcctggcctcagagcttcaatatcctggcgagatcccctcgcattatatttcatgaggcttaaatgcaagctctcccacagcaagcccgagagtataatgggggttttaatacattccttttacctaaggctgggatccatttcaaaaagttacccaataggtttcctttcaggtgagctcattgctctgacattccaaaatgacattaaaaaataaatcctctgatgactatattaatacagtacctgggacactgagagttatgccggaaaacgtcttagatgtctataaataaatcttagaaaaaaaacccagcaggaggaatgtgaggagctaatggaattcaaaaggcctcattgctacccccttagagttgaaatccactccgggccgactgtcgcagcagatataaaaagccagccacaggctgaagctgtattagaaaatactgaggcaatagaatattaatctttttctccaaagaaaagccacggactatgctccttggaagatggcttcctttgctataagaagtacactaattaaacatgtacaaggttaaatcctggcaacatgcagctgcttcagggatcagtccttcttgacttcaggtgggaggcattccccgcagaggcaagatatacatgaggcagtgtggggagaatgacgtcagcctcccaaactggcacaaggacctgtgtgtggccttaggatcaaaagcgtccttctttctgctttcctaaaaacatatcttgaaattgccttttatgcctcaacccatcttccttgagatgccgtttctccaaggaagtgctctgtgccctctcagccttgcaggtctggctgtgtcaagtgccactgtgcactactgagggactggaggaactgaaaagcattttggtcataggagggaatagccacgggagaagtcaggcctcagacactcttgtttgaatatggatgtttgagccttagctggtagaataaaacactctttcagagtttgaaatagttttactgcaaatggagtggaaagcgaagtttccaaggttttataaacaacctgatataaacacagcagtgttgtaggtcaaagcagatgtggtgaacagaacttacaaagacatatatgtgtatcagtttattttttccacgttcatttcaacctcagcagagctagcaacactaacactccccagtggcagagccaacaacagggctctagaggctccaaacttggggtcctcttgggtgtccttggatagaattcaaggggtccataaactagaatagaaaaaattatatattttcactagtctctagctgaaagataatgtttacttcaattatggatgtagaaaaatccctatagtgttagtactactgtgattttctcaatagaaatcatgatattttcacatcaattacagttgtagatataaatctgtaatatacctgtagcatctgtttcactgtaaatatatattacatataatatatagagatgattccccttgaaattcgaagtattttattttacttatttgaaaccattctaagaggagactcgtagccttcttcaggttgctaaaggggtccatatacaaaaatggttaggagtccctgtactagggaaacttcccagcagaatggagcaagtcgtgtcctaagacactatctacactactgaaatcctccattttggctaaatgacaaagcactggcaaaagagtcagaaggactgcgttctgatctctaacttattgcatgtcctttggcaagaaagacattcaagcttcttgctattcataagaacacagctactcatgcttacaatgtgccaggtgctctgctaactacatttggttgccacaatgatggttcagtcaacaacagaccacatgtatgacagtggtcctgtaagattataatatcatatttttactgtatttttctatgtttagatatgtttgaaatacacaaatacttaccattgtgttacaattgcctacagtagtcagtagaggaacatgctgtacaggtttgtagcctaggagcaataggttacaccatatggcctaggtatgtagtaagctataccatctaggtttgtgtaagtacactctatgatgttcccttaatgaggaactcacataatgatgcgtttctcagaatgcatccctctttgtaaatattacttcctgtagtcattacagcaaccttctgtggttctattgtaatatttattttgcagataagaaaattaaaccttagaactgttaagtaatccatccacagtcctatccagctaggaagcaacataaatgaaaactttctccaaagctattagatatcatagtctagcaagctaggataacaattcctgccctacttacctcgtaggatttttgtgatgctcaaatgaataatagatacattagatttaaacagtacttcccacccttcaaaacaagttatgaatattttaaaatgattgttattgagattttcaagtatagcaaaatgttgagttttggaaataaccagtgaaaagacaagatgctatcaaagagacttttgaattacatttcatatttaagtggcaatataattattacaaggaatagctgatggactgtataaggatctatgttaatgctagataaaaatggaatcaaatttatgcttgttagtgttgtgctacacggcttgataagtttttctcataagtaaataaaatatgtgcccttcaatctggctgtaggcttttaatttatttggaaacttttatctcctacaaggttttacggaaagagaaaatttagtccatttggccaggtgatatcaagacccagaaaaatatggcttgaccagctgtccagaattatggcctctctcctcctttcctcagtggctctattgaatttctgtgcagggtagagggatctctgcagagacattctcaccttgacatctcagggtccacttacctgactaacgatgaagaagatgacagtcatggcagcgcaggccaaggtgataagcatgaggaacttgaacctaaaaattagcccctattagaaaagaaagagtagtttaatactccatcagctaccaatccttttctcactatgtaaatctataaaaagcttaattttaaagaaatctgtaaaaccaaatccctaagaatgacagtaaaatagtttcccatagtaatatttcttctgcagaggtgagtgtggctgaaaatttcttgggccaagtatttcctatgttcttatcactcataaagcagcgatacgagagcctgggaaattatattcacaacacgtcgtgaggctgctaatttccctgctaagctggttatgcttctctgcaagggttcaaagttaccaaatccaagttttctgtggttgtaataaaattctgctccagtgaacaaaaagaaatgtgcatattaatcaacatgaagtggatttggttgaattttctcatgtcactccagctctggagacaggcaagccttagaaagtgcctgtggtttcctaagagcaggatttaagagaacctgtgtttcagagagggaggcctattattcaggggctcttctgtgcagatctactgcatataaaaactctgaggttctgtagtttctgcttctcttttcatacaggaattaggcttgtttctccaaggacagccacttaggcatgaacccaggggatccctgataaatcaaggatgtgttgcttgcattggggatttgaggatgttaagtgtttctcttgaatgaggaacataatctataaacagagattactgaactctgtctgagcatctgctggatattttaggggaatgtggcctgttaagagtctggaaatcagatcacgtgggctaaaccctgtttaattacaggacagggttgattctgggacagaactttgactaaagcctcatcccaacaaaatcccaattatgccatagtccaatctcccagctagtatgtaacctacattccatcaccaagctgaagaaccggctgaacaagtttattcattactgaaaatggaaacacatttgtaccacagaaaacaccaagatttaggccagctagatgcttctcagagtaagatttggcctctaattttgcccagagatcctacatgagaatctctcaatttgtatttcaaagtaaaggctttctatctccagggtgtgtgtgtttacacatcaagtggaaagatcaagcaagcaccagttccagaacgagccaagaaatctgcccacctcatagtgtagccgccggactttgctcatagctggcaggctggactgcttcccactgatgttccgaaacacctgaaataccatgaagcatagaaacaggaagtagaggcagaggcagattccagccacgatgatgaaggccatctggtcgtgtccagtaaaggaaacaacgggctagccaaggccaagttgagccgggtccaggcccttctccccaggtctgttggcaatacttgttttgtctccaaatatgtagaaaattttcaaggggataaaatattaaaacctgatattctaatgccaatgataggtttcttgacacattagtaccacagagggaggtgttcaatattgctttctaaaccaagtaagaaaagaaatggtgtcttgcttgttagaaatgaagaatctaggccctaccctagacctaatgaatcagaatctaccttttaaccaggtccccaggagatccgtatacacaataaatttgagaagcactaataaaccatatattcgtcactatggatcagatgaaaaaccacagtaaaatcaccagaagggttcaaatgtagatccccaggtccctccctagatatatggaatcagatattccagggctaggacatcaagtatgactatgtttgggaaccactgggctagtccttggagttttataagaatgcgattgagatactctggcataattgaagaggagatacgtgggggctcagtgcaggggacctgggcatgggcttgaaagtcttaaagtgaaaccagggatgaaggactatttgcaatcttctgtcaccacagaaaatcttgtccaacagaatggggattcaaggacacatggcacaggtgggagtctgggttgctgccagtatacttgagacccactagggagactgacctgccaattagagccagtctgagaaccaccaagtcttaggatagcgtgagctgccttggaaggcagatgacctgattccaacccctttctgctacaactttgcccaaattgcctttttttttttgagacagagttttgcttttgttgcccgggctgaagtgcgatggcacaatcttggctcaccacaacctcctcctcccaggttcaagcgattctcctgcctcagcctcccgagtagctgggattacagggataagccaccacacctggcccaaattgtctatttttaaaagcatttaataagtatgaacttggcgtgcatatttcattaaataatataatatctaatgcagtttctccttctttcctataatgaacatcatcctggaatgaagggaatatagttattttctgcaggacttgaaattttactcactccatcctatctacaaaattaaaaaagttgaactagatttaacattagaaacattcttcttgttgtgcagctaacatttggtgggggcataacagaggaagggtagagcttctctctcatctttgaggaaatgatactactgatttagtttgctcacaatgttcttgtgacactgagaaaccaatataaacatcatggcaagacaaaggatattccctagcacgtggcaagatatgagccatcaaggaagaatacaacccaagcctttctctccactccagagcagagtctttttctcccaagatcatttcacatactattccggaagataaaatatttaaatccagcatcctaaaagggataagctaagactgtcacttctgcttcatgaagatgacttagagtttatgccaaccaaccagaagccttggcgacttctctggaactaatcaccttagccttatctccacttggtctcaggaataaatagcagcagtgtgatttgccagcacaccaaggtcacttaagaagtctcacacataggtggtttcagaaacaggctcttccacaggggcccagagatgaacctccatggctccagggaaaagctagtcatgcttcagtctgcaggaaacagtgtataacagataattcagacaggctgcagtaagcctagcaactcggatccctctgctgtgaggataggctgtgaccttctcattttgcctgctctcacccaggcttgaaagcaagcagtaattcttcttattattagccttaattgtgctgttatgattggcctgagaatcaaagccctggctgagtacatatggggagcatcagcagagccttagaaaatgatcttggggactgggtggccaggggaagaaataaaaccctgagcccatcaaggaaggatacggccagctctgttccaatgtctgtagtccagatactgtagaagggattcgtgagttgtacccctctacaaagaaaatgagatggaaaggcaagacacaattaatacaaaggcaacgggaactttccttttcacatattcttagcttttcagctgcaggggtgagggctgtatttaggctaaaaaacattacagaaatcctaaagagaaatgaagcttgtagaatacatcggcccaaatatttttcaactgtaaagagctgtgcctttgatttgatcccagaccttgtctgaggatgtgaccacgtccagtgcttccaaaccaaaggttcccgaccaccattctccttttcaaacactcctcctaaaatgacaggagtgggcgtggtgatgcacagtttggctcagtgtcccacaaacacttgctcacctctcacacatgtcaaatatgaagaggcagaaggagccaacggcaatgggtccgacttgcttccaataccctgcgatgtggttccgctcgtgctgatcctgaggaaaaccaaattgagaagggagatagaggggagaggaagaccaagcaattctatgggggagtcagcattcgaaggacacttgccgaccacctattgtgtatcaagcactatgctagattctaggtatgagaacaaagaagatgaaaatctcttcttcaggagctcatctctgtgggggagtctggcacatacgtagaacatgacaaagcccagccataagggctctgagagtaataagaacaggatgccatgggaacacaaagaaaggcctcggctcccaggcaggggacattttgtggtccacaaaataactcattctgaattaaatttctacgtgacttgtaacttgtgtttataaaagtgactgatcctcagaagacaaagtaaagacattaaagcatttaaatatgtaaagtgtgtctattatggtgaggaaaataggcatattttctccccatccttattaaaaccaggaatgagtccccttgataaacaaagacaccaagagaaagaaaaggaaggaatgtagaatgagaaaaaagggaaagcaaagatgatcttagcctccaggtggggccccaggtgggtcagtccacaccagctccctgcggacaatccttggctggcttcctggtgctggaccaagttccatccactcccccgccctgctgctgaggcctcattctcagcgcatctctgctggaggacacctcatggagaaagaccccttaatgtagacagtttagcagtaggaagaagtctctctctctgctctcacactgctctcctggaagggcagcaggacttgagaggtctggttttcatgattgagccataatggaatttaaaaacagtccactctgctgtgaagcccatgtgcctgacgtgaagaccaagttccagctggcatatcatcttagccacaatgtgatgatgacaccattcttatttttaaccatggtaccttcaatccctcttgaaatatgatttggtgtctgtgcaaactgaggagaccgggaaggtctgtatttcagagtaataggggttactaggccacctggacacattgccagctggaaagagccaggcccacattctctgatggttaacctgtattcctggggacaggacaagcagggcagaagccagcagacaagaaactcaagctcaagggcaagaaataatactaatcattagaatgtgtgtgtttatcttaagttactcacattctgtcatttaattctcatgaaaaccccatgcagtaggtctttacatcccattttatagatgagggacccgagattcagagtgataatgtcatttgcctaaagccactcagctggtcagcaggtggtgaagcaggaatgtgaaccagagggtctgcctccagagttcccacttgtaactactagtttattctgtctcacccactgctgactagaggcaaaggggggcaggtgtcagcttggcagcctgcacagagcagctggtacagacgtctgtccctcccggcggctcttaccatcatgtgctcgccacagaagatgatccagaaggacagaagcatcgcatagaagatgccctgtcggatgtcaccaaacagcagcatccaggtccagtcaaacccgatggaaaaccattccactgggatattgataaaggtcatggaaatcccaagggcaaagatgactctgatggtgagaaaatatcaggacagccactttattcatctggaaggcagattttcaaacaattccccgaattcagttttgagacatgagatgttacttattgggtctgaagccatatgatcaatttcttctgcacagagatgcaaaacgtcctatgtagttggcactgctgcagaatgagggagtgctataccaacctttctatggaagtgaacctgacctccttaatgcctcacactttactttggtaccactgcagatggcagtcttcctataatgtttgtgtccccttgccttctcacccaggcctcagtgagtacaattgtcctctttcacctattcaggttatcattcatctgatcattaagaacactcattattattgtgatatcctcagcaactatgaattatataagcatatttgtttcaataatacatgactccaaacacatttgaaatgtaaattctcttgactgcttgtttagcttttattttactcttcccctgtcacactaagaactgccaattctctactaaaatataattcttaagtcactgatttattcatacttttttccatccccttgaaacacatatgttaattaagcacagatcatgtaccaggtattgtgttagcactatggaatcctaaatgaacaggacctgttttttcactcacgggagatacagttagtagaggagccagataaagagacaactgaatagattaggatcaggaacatcatagagttttaaagcatagagggctgctaccaggacttctgactttgacacagacaggaatggagctgacttgtgagtcaaagtgagggaagtggaaagggtgtttggaggagagggcagagcctggatggaggcatagaggcctggaagaacctgctgcatttggggatctgcatgtggcacatcaggaaatgacaggacatgagaccagagaaacaaagagggctgtgctcatgaagaaacttgcataccccactggagaactgaaatttatcttgaagagactttttattggaatccaataaaaagtttaaacaatggagtgacatgattcattcaaaaaatatttattaaactcctactatgtgtcagtcactattctaagatgctgggaatataactgtgaacaagaaaagcaaggattgtgctcttgtgatgcttgcatagagatggaatgagagagggagtacaagaaaaagataataaatgaagaatgagcatcatgaaaaaaaaagctaggcaagagagtggagagcaatggggatgtgattttacgtaaggtggacagacgaagagatcagcaggtgtgaaggccctggggtgtgggtttgagcacaataaagggggctggtgggtggtggagaggacaagtgacaagatcagaggtggaaggcacccaatcatcaaggggcttataggtcagggcaaaggagatgaaaagccagtggagagctttgagcagaggggtgacaggatctgattaacacttgaaagggggcactcctggctatcctgtgaataggctgcagggaggcacgtgatggaagcaaggaaaggggttgcgaggctgttcccactgatccaggtgagaagcgatggttggttagttagattagggtggcagcagtggaattggtgagatttcctggtgaggttgatgagaagtgtgaaaaacagagacatacaggatgactcactgctacatttccagtctgaacaactgaaaggatggagttgccttttactgaaatggggatcctgggagggaataggttggaaatgggacacaatcaagtgttgttcttggtacatgtgacattttcaatgcaaatgaagacattaagtaaagagctggaatatttgggtccagagttgggagaggctgaggctaaagatacagattaagagtcatcagagaatagatgatttttcagaccacaaaggtaggtgaaatcaacccccctagggaaagcacagctaataaagagaagaggtccaaagcaggtgccccagtcccaaagtctaagagtctggaaagatggaaggagacaggaatggaatctaaatgctggtcagcaaagaagaatgaccaacagaagggtagaggagactctgggaagaaaaactgatcaattatgtcagatgctgggatgaataaaaaaaaagtgaggaacaaaaaatgacctttggatttggactatgaaggttgttggtgatcccgtgaaaagcagttttagtagagtggtggagatgaatccagactggaaaggactcaagagagaacagaggagaagacatatgcacaaggtttttgagaagcattgctgtaaagaggagcagaaaaagggtatgtggcttcagggggaagtgggaaatgggagaattttgtctaagaatgggagatggcaggacatgtttgtatattaatagaatccagcagaaagggagaagtcaatgatgtggagagaaagtaggtacatctacaggagcactgtctttctgtaagtgagaggagctgggcttaggggagtttcttcactacaacacagacaagtatctgattctgaccacggaatatcccgaagagcaaagacaggttaaagaaccagaaaggtcagctgggtgtggtggctcacacctgtaatcccagcactttgggaagctgaagcgggcaaatcacttgagctcaggatttcgagatcagcctgggcaacatagggaaaccctgtctctacaaaaaatacaaaaaactagctgggaagcatacacctgtggttctagctaccgggaggctgaggtgggatgaccactggagcctggaaagtcaaggctgcagcaagctgagatcccagcactgcactccagcctggacaacagagtgagaccttgtctccaaaaaataaattaattaattaaaaagagccagaaaggtgagagaggtagaaccccgaggatttacttaataacaacttgcataggaaaactgcaggagaaaaaggagtccaggatgactcctggtcaaatcactggcctaagtcacacactggctgcttgaactggacaccagcaaaagcaagagcttggcagatcatgagaagccagtattcctgaagagcgctccaaaaccagctcttacttttccagaagcactgggggtcgggacatcatggtgatcctcctccaataccacaccataatgatgaagatgctgggcgtaaggaaggtcttcatggcaaaccacaccttggtgaagcctccattttggtggatcccctaggcagagaccagtgataattttgaaggtgaatattatcttagcatttccttctactagcaaatgcttttgtgggagaggtaagtggagacctcgtctgcgaatgttcacgatcaagagctttcacattcatagcaggtactgccctcatacacccttggactctcctcagagataatagaaatacatattaaaagagccctgtgctatggacctgagaccagagaaataaagagggcatcccattcacaataacggctttcatgttctggggtctgaaagaagaacatggggctttggggcagggtcactatttccaagagacttcgaattatcttaccttggactcatcccactgatattaaaatgctaatacctaaagatacactttagaggtacggattaatagggcaggtatggattaatagggcatacagggtgtatgatatctacccagctaccacccccacagtgtaccccccaaaaaagccacatttgaggtagaaccagaaatttcaggtaaaaagcagagatatcctctatctcttaacacctctcttggccgtttaatcctcattctaccctcacatcttactaatctggtctactaaggctacaagagctttttccctatgctaagattacgattaagtacatgatcaattttttttgtaagcttttcattagaaagttgcagatatcctagatggtcaatatgttgagattggtaagtgttaaggtaaatctattctataaaatgctaatcaatattggaaagtatatttatattacattcaccaatttatattacatataccattaaataaagaaagcaaggaaaacagtcagttcaatatgatcctactttttgtaagggaattactacgtataaaaaaaagcctggaaggagatatatcaaaacctgaacagtgattatttctctaaatagtaggacattacaggtaattattatgcttttctgtgtctctacacaattcttgtgggactttgttgagattgaaaagaaatggcctccttgcagcaagttctaacttttccccaattaaacaaatatgatggaaagaacctaaaccacccctattccttttaacatttgtgcttgcaaggtgaaacacataaaaaagaaaatttacttttatctcagtgttattcattatgcaatcatgactatttcatgatcttatcatcattgtaatgatcttaagtgatcttaagcccatttaaaatcttaagtgggcacaataattgcattgtttcccatttctgtaatctctcacacaaattagttcactttatgatctcagccatcatgagtatgttattattcccatttctcagatgagacaggtgaggcatagaggtgccaagagtgagatggagttcccctccaatacacatgtcaagatcaattacattcacttaccaccaaccggatatcctttatctccccaattcccacattgattttcttcttctcattcacaggcagccggatgtttaaaaggtaaaacttatgggccacagacccaatttccatgaaaggaaggacatcacattcatagtaacggccctcatgctctggagtctggaaaaagagcagagggtttgaggcagggtcactatttccaatagactggctctgaattctgttaccctggatccataacatcaattgtaagcagctaatgcttaaaggtacactttagacgtacagagtaacaatgcatactggaggcatggcgtctacccagctatcccaacctaaaacaaacatcaacaacaacaacaacaaaaaacagctgtattcaaggtagaaccagaaattttaggtagaaagcagagataccttccttctatctcctaacacctttctaggctgtttaatcttcattagaacctcgcatcttacgaatcttgtctgccagggctacaagagtttttatctgcagtgtgttgtcagggtcctctaaggctctgtggaacagtcagcttcttaaacgttcaggtggaagctcttgctgaatcattacactctttaatgacggctaattattctcctgattttggcctgagggagaagctagaagaagctgaaaatatcttctttttattcacttgccaggaaaaaaaaagacacaaggagccgttggtatttagggaaggtcgaaacagaagaaagaaagataataagattagtggccagagatacccactaagaattttctgcctccggtgcttcctaacagtccaagatggcagaagggaatagaagttttaatgaaataagaatttagcccagtgtctaggaaagcctcttggacttcgtgccaaacaatttaagagatactgcccagagcacggtggtgggaaattggacagtagggagacaccttttttttgaaaactaaattctgctccacctcaccaggactcccggctgtgtacctgctgaggggtgggggccaggggtaaagatgagcataaagaggcatgagcttcagcaggccgggacttttccctgatatagaagatgagagtctaccatcaatgttgggtttctatgtcagcttcaatgtttccttggcacctcctgatcaagtgataggggagatctaatttgtcgttcctaagcctgaatttgcaagacctccataatttgtcataaatcttcagagcaaagatccactgaagaagtgagaagaaagaagataacaaagagtccatagtctaagagtatgtaggaaggggctaggaaggggctctgccccttctgagatcttggctggtggggagggttccttactgaacagtcagagcttagaatgcagtaaacagacctttgtacagagacagagacacacacggcaaggtagaggtggggaggtgcttctacctcctcttgcccaccacggcacacataaccaatcagtcgtcaacagtttttatccctaaggtgtgagcagctcttgtcagacacaccagttgattagagttggcatgtgagatttttaaaaattcttctgtagaaagaatgctgctttttcaaacctcagctgcaggtcagatgattcttcctatatagatcatctttctctcccctccactcctttctctcttatactttcaaatcagggaggatgggggctctgcaggtactactaaaagttcactgcaggctctaattctccctcagattaagctgcagtgaggaggctgattatcctctgtggtaacagcaagagggtattttctgatttgtttccagttagggccttattttattgatggaaattgagaacttgagggcggaagggaacaaaacctacttagtctaattccatctggtgtgtgtctcgcccagggtcccaaaagtagtagcagaattgggagaaggacatgggccctgcccaaaggcaggcattgtgctgtgataaagactcctgaactccaggccaggaggctgattctagtcctgaccatgttccttgctgggtaccttgggtcaccctgcctcatttggcctcagtttcctcctaagtgagaaagttaagtaagatgatctccagggtcacttctaatcccccacgatgggtctctgggtgccccacacttccctgtcactactgagtgagtaacatggacacccttgacacaaatttacctaagttcaaattaaaagagacacattggcatctgggacactggctcaaccttcctgtctcagagacaagttcgttgtatcctgttagagacttttcttcatgcactaaagtcctgcctctgccagtatttagggcatttaagaagattcctctctctccttcctttgccccacccccagttctcccccaactccagcatgagactagctcattaggacaaattacagcaggtggcaacttgacttttttttttttaacttcacaatccaccagggactcaaaagctttaaagcaatttctcatttaatcttgagactcaagactaaatttcactgcaatcaaaaagcagagacttgatgattcatttccttcgcacttttcaagatttaatatctttcttgcaagggatcaacacatcctaaagataattaagcattaagaagcagttgcaggcaaacacccttccccctcgctactcagtgccctccatgtgtataaatgagaaatgacttttcccttttctatggataaaattctgtatccgaaagccatctagcttagatgttcaaccagtatttcaaagatgcagtcaacttgcagagatagctagaaaggtttttaattttcttggttgcatgcaaagatctgaaaatgttagctgttcctctctcctgcttcctctagtttgtctatcattcatttctacctacaaatggctttctctggaggacagccctatatttagcactcagcagagggtctagggcagtggctctcaaacttcatagagtttaataaactgaaggcctgttaaaacacagattccttgctcctacaccctgagacattgacttaataggttctgggtgtgccctgggaatctgcctttcctaaaacctctcaggtgatgctgccactgttggttctcagaacacattttctgtagctttgttctaggaaacctgcgggagggagactcccctagtgtttcaaaaaacactgcaatgggtacttaggtttacccatggagggccttagtttatatgttttctcctagtggcccatctggttaatatccgctttgactctcaaatatgtcccagacaagatgttaaattagaaggtcatcctgcctacgtcattgtatcatctagtccaggggtgtccaatcttttggcttctctgggccaaaccggaaggaggagaattgtcttgagccacacataaaatacactaataatagctgatgagctaaaaaaaaaaaaaatcacaaaaagaaattataatgttttaagaaagtaatgaatttacattgggccacattcaaagccgtcctgggctgcatgcggcccgcaggcagagttggacaagcttgatctagcccttaaacagactcccaaggtaggtactcttatctcatcttgcagaagaaaaactgaagctcagacagattatgtaagcttacctgaggtcacaccgtcagtgataaaaccacctaatctttctcctctttaggaaaaaaatggctaaagctggggcaaggtactcagaggcttcaacctcatgtttttactattttgcaggaaatcttaacagtaataggcaaaagcaaagttaggaaaggcccgtggcaggagagaagaggaaataaaatgctccgcagagcaggtattaccaaagctgtcctcatgcgaagaagggacacacctatgaaaagtaagcaaatctttccacatacctgagaaccaaataaaaactgtcagcttagacagcaaggggtcataccttgggagatgtgaaggtgcatttgagtttccgtggtactctttcatgggccatttcagtccactcagcaaacgcgtcatcacggtaagccagggaaacgtccatggagacttctgcattttctcctgcaagagaaaggatgcacgtttcagaaatgacttttggaaagatattttagaaacagctcaaaaaattcttataggctttgacttggaaaccaacgagacaaaagggaaatattaatttctatcaaactccaaacctgaagacttagaagtcataggatgaaagtctaagccaaatgctgggtcccctctcatgtccactctgccagagtcaagagcctccatttaaactcttccagagacaggggcctcactctctctgagggagcacaaatggtcagacctcatcctcccataacttgtaccatgggtcctaggtctgcctgtagaagccacgtggaaggtgatgtccttccttcttccataaaaagtgccttatgttcttgaaaaccataccacatctgcctgcattctctttcctctctgataaacatgaccaagtttttcaaccacctctcagacacgtccctctggggctcttctctggtcacactctgtctgaaaacatccttctcaaacttattcccgaaagttctcaaatataggatttgctacttttccaaaagtcaaaatcccttcatattgtggatgaagttaatgtaaaaggcaaagtgtttttccaaaattaaagacttatacacagataggaataatacataattgcacaaatgaatgttcacacatacttccatatgtgtggactggaccacgaatgagttaaactcaccacagaactcattaaggagatgagattaataaaacattgcacctattaattttgtctgttttatactatgatgagcaagttcaagagcagagaagtcttttttttttttttttttttttgagtataaaggtttaattctatttaaaaagaaagtccattaaatcaacttcaagttcttaactcatgggactattttggaacacttctttgtaaatatcattttgttaggttattggcaaaacagtttcaaggttcacttccctcccttgaaccaggtccaggtcattttgctttggggtaaattaaaatcagaattctaaaagttgagcaactttgtttttttttaattgacttagctctaacccaccattacaacttaaggacggcatgacttgataatgatggacttgtgtgaggttttgagttttcaattaaactttgtatcacatgaggtaattgtcagcattcttgagtctggttatggaataggcagatagaaccctgtagtaacaagagttggaaattggctaattgacaacgcacttgccttaaacatctcaagtagagaacttttacattagtgagatgtacttgaatttcagaactcaacaaattttaattactttttactgaaaactgcagtgaatgctaaatgtctacgtttacaataaacaaatacagtaacagtaactcacactgaaacaaaacatacttctgatagccattatttttctgcttgggacaattttaaagtttttcttttgtcacaaaaacaggaatgtatccaaacaaaggctcaaaagaggccatcttttcaaacaaaaaggcaatgattcacaaaagactgtgaatagaacatgtaactagttgatacaaatctaataggatttgttaaaatcagtcacatctaatacatctgaagtgctcttgtataaaatatcacgtgaagaaaagaagactttatcaatgtctaaaaaagtgggtttgttcatagacaatctgacaagttaccataaaaagtgtttcctgagacataaggaaatgcaacattattcttcttgaaccgttttagctcaactttccactcaataaaacagcagaggatctgaaactgagaaaatgtatttgagtacaaacagcttgtgaaagttaatactttttttttgcatcagagggtttttactgaacttacaaccaacttgcccactcagtatgcagttcagatgtgagagatgcttctctgtacaggagcctgtactgtcttcaatcctatgcgagcaagtgtctaccacaggcaaacagttttctccccattttgtagtaatgtaattttcctattagcaaaaggaggtcaccagcccctgtagacttaagggactcaagtcacaggatggggatatcctcttaatattttttattttgttgtttgaactcttgatgcaacattgtagagcagggtgttcaggacctgctgtgcccaagggactgataaaggaaaaagctctatttattctttgtgatttgatgcacagatgaaaaacttaacacacaataacagaagttggtcgttaataaatcacatcctagtctttcagcgcttccgtaagcagacgacatcttcagttttctagctcttgtagttttaacactgcagcatcaatgatgcataagtccagaatcagttacaaagaccatcatattctttttctcttagttcatcatttttcactatctcttggtcccaaatgtatctgaatgattaccttccggcattctctgctattgctcgttggagtgctctcgattgtccccgtgttttgtgggctggttgggagagggcgcctgggaaggatgtgccactgttgggaggttgtgagtcactgggatgcctccagggatgatcccttccacggctgcaggaagtcctcctggagccacgcccacgatgcctggcggatatctgtatgtggcaccattgagctcaggatgaattgcttgctggtctattactgaccaaggcgctgatgtgacagagaattccttgttcacacagtttcttaagctttctgggatgtgacctgtgatggctcggcggatctcagtggcagctgcctccctcatctccagtgacgcctgcttgctgtaccaggcagtgtgaggagtgcagataagattcggtgcatctttcaacggaccctgagcaaagctaaagggctccgactcacgcacatagagggctgcccctcgtatcctgccctccttgagagcttgtgctaaggctttctcgtccaccaggccaccacggggtgcgttcacaaggaatgctccctgcctcatctgctttatggtaaagtcattgatgaggtggtggttatgttcgttgagattgcagtgcaaggagacgcagtcgctctgatacagcaaatcctacagagtgtagaccctctgcacgcccagggatcgctcgatcccatcctgcaagtaggggtcataaaatatgacgctgaatccaaaggccttggctcgaactgcaaccgcctaccccctgcgatcaaagccgatgaggcccagcatttccccacggatgctggccgatcccgaggccaactcgcggttctgctccatgctctgaacccgtgtgccttaccgcagtgcttggtacagccatgtgttcctctggtacagattgaggatgtggcagatggtagagtccggtgtctcttccacggctgcagacgggatattgcacacagcaattccgagctcgctggcagccttgatgtccacgttatcgtagccactgcctatctgcacgatcactctcggggccttaaacttttctaggtcctccctggtgaggatgatggtgtggtacatcatggtacccatggcttcgttagaaccttctcgtggatttcctgcgtggactgcgcgtcacagaaggccacagtggccaggtctttcaggatgggcatctccacagtgcagtcgcggccgtccagcagcgccaccagggggcaggagtgcagggggccgttcatgatctgggggcggataccttcacaaattctgtccaattgctgtctcttgactttgtgcttatccacaagggccatactttatggaactttgcaactctcagatcaaaaggcaaagcagtcctctaagaacttaggggaactcgcaggagtctccgtgcatgacgccactatgaacccactataaatctgtacacactataaatctgtacactataaatctatagttcacacgatgggctgtccgtctttttaagggaatacagcttcattggttcaaaaccatttaaggtgatgaaaccctcgtcccggacggtcagcgtccacggcaaaaggcgcccactctggaggccgcggtggcggtggctcccgcccctcccaccccaccctgcggcggtggcggtggcggtggctgcagctgtgcagcctcccctcagcgcagcatggctcccttttcggtccctcgctcctccgggccgctcccgagccaccttaaaatgacgctcgcacacagggacacacaacacaaaaacttaatctctccagctccccaccactccccctccctccctccgctaccccgctctccccaccctacccctccagagaagtcttaatgaggaaaaaaaaaaaaaaagcacaaatcacatttccaaaatgactggagatcctgccaccactagggttatgaaaatgggcacaattttaggctctggctattcagccttgaagaagtctcagtatccaggcacctgagtttgctccatacccacctcctccagggctgcgacaaggattaaaagtcaagttagtgaaagcactgcatgctgcctcatatgcagtaggtgcttaataaatgtttactaaacctgaacacatacaaatcacaagggaaacagataggaataactgccctctgaaaagcagggcttttctacggtggcttaaagctgacatggcagcatggcagatccctggttctcagaagaaatctcggaaaaggaagagatgatccatggaagaaggaatttgaggccattctgatatagaggaaaccctcgatgaacatcagtacccactattctattattcctatttttatcctcagttaaacatagtgaattagccactgtgttttcctcctgaaattccacaaaataaagacaaagacagtaaaaagaaaagcaaaagatattaaatcacaaggggaaaaaactaactgtagacacatgagcagacaagagatttcatttttttttttttaagacagagttttgctcttgttacccaggctggagtgcaatggcatgatctcggctcactgcaacctctgcctcccgggttcaagcaattctcctgcctcagcctcctgagtagctgggattacaggcgtgcaccaccatgcctggctaattttgtatttttagcagagtcagggtttatccatggtggtcaggctggtcttgaactcctgacctcaggtgatccgcctgcctcagcttcccaaagtgttgggatcacaggcgtgaaccactgtgcctggcctcaaaatttttttaaaacataaaaaatacatgaagtagggtttcctggcagccacagcctacactcctatagaggggatattctagaaaagtgagccaacatatctgcaggaacctgaagccactcagaatttgaaagtaccaggggttgcagaaggcagaacaaagcatggcactgacaatggggtgactgggtcaaagtctgcacacaaaactgctggacctcagttctcccacatcttcccatctgtgcaagatccaaggagagactctggacttgaggacaccaggggaatatgtagacccagggctggaggtggagaagagcaagagtctgtagaagaaactgtgccactcccagcttggcagaaacaatgttcagagttggtatctccccttggtcagggaccaagctggctacaacttctccccacttagtagcctcagtggtcaacagaaagaatcagtcagagctcccatggagtcaaatcttaggcaataaagtacatcctacttataacgctgggagtaggaattgggactttaaactgtgttgaaaagggtgcttggagaaacacaagagtataaatatgaaaagctgtaaaaaatgtcatcagctcacacacaggttacaaattactcacaggttgttctccttggagccatagggttcagagcaacactagccttagacacaggcaagaggggcctttgaagtttgggccccacacttttaaagggtcccacacttttaaagggtcccactctgtcaactgttcccttctttataggacaagaagactcccaagtgaaggggatatatatacccagagcctacagaccccctcacttctagaccacgctccgagatgtcagactccagaacattctgcctagacagctctgaactcttatcttacttccaaggtctgtgtggcctctttccaggtctggcttcccaagaagaactagacaaccacctgtatactcttggatgttcggtgggggtgggagtgaaaaggctgctatttgttggaagatatgaacagagcttgagctcggaggttagggtgtccatgtagaagcacgcaaggcccctctctttatgggatggagccagcggtggggagaaaaggggtgtaggggcccacacttcctgaccagtcacattttggcacagaattccaagtcgtccatgagtcctcaattcgaacctggccatcctgttcattatgcaagtaactcatcatcagaggatgcaacgtacttggcttaacagtttgctggcctgatttatcacttctaaatatttagacacatgataggcatgccttcattcatactgtttccccaagccagacaaatgtttgtagtgggcctggttcagagcaggtgcctcacagagacaaggctagataggattgcttccttgcctggtcccagcttcaaaagttattctaatctgttgaggatcctcaaaggaaaaactattttaaaatatgcggtttaaaatgaaaattgtgcacagtattttaatgtacaattactccatgttaagctcctgtggtttctgtgctttaaattacctcatttaatgttcccaacaattccatgaagtggacagaatattttattttaattaatgagtaaagtgatgccctcagatcttaaggaacttgtataaagtcattgaaattgccttaaaataaaatcacttttttggtattgcttaaagaaaactggctaacttgtgatagaagaagcccctcaaagcagtcacacaatatgaatatgctaagtctttaataatagcaacagctctccttcatcagaggctaacatgcaccagccttcttcaggcctcacatccatcctgggaggaagacgttatataaattgcccaagaacatatggctagtaaacagcagagctcaagtctggatcacgtaagggccccactgcactctactacctttgctggtgaaaacaaacaaacacagtagaattcaaaagaagctaacagctgaatcaagcatacttggtcaaagagccactcaacacaaactaaatacctttccagctttctacaggagagaaacaggcaatgttcctgggaggctgcaagtatggctcataagaatgtctggaattatctaatctaagctttctaaagccatctattgttggctgttaaaattatagcatgttctgccgtctcttcacgttaccatctccttacttcccgtgcaatctgaagcagaggtgttattcctgtttatgaggtgaagacgccataactcagaaagccctaccctagaaataccagactcaggaccctagagcttcatagccaatagtctcatagcatcctgccatcttttatgatgtacataaaaaaatagaaatcacagggagaatggcctgttcaagtgacctttactagactgtgatatcactcctcacccccagacagatagcacacatgaggtagcacaggtcaatcttagcagacctggttccttacctgttaggataagacttaacgcctagaatttcatgattattacactagttactgcatgaaaaatgctcaagacagagcagaaagcatgaagggtaaggtattgttgttgacattttattagggaagtgaaactcttatccttaattcaaaataattaccaggtttcaggaacatggagcttcccactatgaatccctaatccaaacctagatcacaaaacccagaaacgggaaagcactggacagaggaatacagtaaaactgcgaagctggttacctgaattgttttctcttctgcctccagtggacttggaaataaagttcagcattaatgatgatgttgcatttaataaaacactggtttcatgactcctgggatactgtgtgggcaatacttcccctccaccctccagagataatgaaggcgaggaatccaatttgaactccctgggagaatggcaggaaggctaagctacatttggcactatattagaactttccctataaaacaaggacactggttatatcagtttcatgggggtacagttgtaaggtatcagcatagggcatttatagatttgaaatccatggttttccatacctatactataccagcagctttggtatagaagcccataggtcctatgggctagccaagcttcacatttctcaaatagctttggagacatattttagttgggtggagaattcattcagaggaggaagggaagtgtggaaaggcactgtcgttcgttacacttactatttccatcctgttatgggggcagtttcccctatgctccagggttccataggagcagacctagactgcaaagtgtggttacagacagaaagatccatgcctttccatgttgggaagcatcaactaattgtatccttaggaagtctgtctctataccagttatactgccctgccctgcttgagaaaagcaaagccaatcagtttttctgcaggcaagtggaaagtcagagaggagggcaagtaccttctataagccagaaatggtgggaggggggtgctagaaatcgctaggaaagaggtctagtgtccccaagaaatctagggcagctgcttaatgtaagaatggtccctggggtgggaatgtggggagaaggaaaagcaatgaaaaggccactagagccttaattgaggaagacatcagaatgcttgtcacctaagctctacaccttctatatttgaaacaggtatttcccagccaggatagtacaaagtgtataaattgggcaccaaatggatgtgattttgaattctccttttatgacttcccacctgaacaaccttgaataagtctcagtttccacctttgcagtatggaaacagtgggaactactccctaagtctgttaaccaataccagttccttctccatctagtcccagggtggctgggttatattgttgacctattaactggaataaaaggggaaaaaggagaggacaagatatattagaggaaatcaggaatgattttatggttgtcaaaagcttttaggttcctagagacactttgactttcctgggcctttgccctgggaaaaaaattaaagaggtttcaatgctcgtgtgcattcccacattacataggggagctgccagtcaccagagtttgtttgggtaacctcagaaagaggccacagagacaaatctcctcccagcctctggcagacatataatctggagttatttatgccagcattccttccccaataaaaaactctctgacctggcttgaatttttcttgacgctttcaattaaggaaataacaaaaccaaccctgtcttatacatggttaggtctggcaaaaatggactcagctaattacaaatttggccctggcggttttcttaagatgccctacaggcctgggtgtgagtggttataaaaatgaatgagtacaattattttgcaaaccagcctaacagtttagttcacattgcttctcgtctttcctcatcaaatcaagcatttgaattgcagagaattatcttccacatgtaagaaaacatatttctaagcattgcaaaactggttccttgctgtattctgatgcattatcatctggttgaagtcacatatctgtctatggaacatgacaaggacaagggagaacggtgctcacattaggttctcttcaaagtgacatgcagttagaaaacatccacttacccctattgtagccaaggctactagtacttaaatgctataccactgaaaaagtaagtggagacatcaatttttttaaataaatgaatctgaagtaccaccgaatatagaaaaaaaccatatctattgttcaccaggttggagagtagctctttcctcatctaactcaacacgttcaccctgaaggatttcatctgctcctgggatgcaagtcaccctctccagtccagatttccctcttgatatttgaatttgcatgctcacttttcaccagtctctcctctttcatggtttagaaatgcaaaccaccaaatttggtcaactctactaggtgtctttcagatttagcctcctctcctcactgatatgccgcttgttcaggccaccattatctccagcctccatgactaaaacacctgccctgttcctgtctaattttcacacttcctgctacagaaatgatttctaaaacactttcaatgcctttatattgtcttcagtgtgatattaagactccttaaatggcataattggctaaggtgttatgtagcagcctaggttctagttctatgaacgttcactaccccttctacctaggttggccacttcaaatacagcccctctcctctccagccttggaagatgagtaagagctcagctttggagacagacaggctgggaccacagcccaccttagctacttggtgcctatgcaatgttgggagtcactaaatgtctctatctgtaagatgaggataatggtaatggtaatgcccttctcctatcactgtgaggagtaaatgagataatgggtgccaagcactcagcacaggcctggcatatagtaagcactcagtcaatgctggctactatttcttttttttttttttttttttttgagatggagtttcgctcttcttgcccaggctggagtgcaatggcacgatctccgctcactgcaaccttcgcctcctgggttcaagcgattctcctgcctcagcctcctgagtaactgggattacatgcatgggccaccatgcctggctaatttttttgtatttttagtagagacggggtttctccatgttggtcaggctggtcttgaactcccaacctcaggtgatccacccgcctcggactcccaaagtgttgggattacaggtgtgagccaccgcgctcggccgctggctgctatttcaaggctagtactcaaggttatctacacctgctgtactcagggtccccataatcacaccaaattttatgaagagatgcctcctttgagagggtaaattacaaaaggcttctttatctgggctgcagacagtgcttggcatccccgctcgtgccagactcctactcatcttctggaattccccccagatttactcttgccttcttttactcacccaaactcaatatggcaccccccccttgctcccacagtaccttgttcacccagcaatatgacacttatgacacttattctccatgttgcttctcctgactacttatccccatctctctccctacccatctcctatttaggctgggttcctaaaagccagggactgactcagtcttgttcacagttatatcactcatgtctttgcacaatagatattcattgaatatttaccaaattaatgattatcatccttctttctccaaataactcttacaaacctaaatttcctgtcactctaccatcaaacaagtggtttgctctatattttggtgacattcatactttctttctccatcacctgcctttttacttctactccccccaaacccctgcacacacacccctgaaatccctgtgctagatggaccatccaactctatttttgtttccaccaaatatttttgagcacctactggtgtcctcgcacaagattggatgtaaagcctaaaaccataaaaaccctagaagacaacctaggcaataccattcaggacataggcatgggcaaagacttcatgactaaaacaccaaaagcaatggcaacaaaagccaaaattgacaaatgggatctaattaaactaaacagcttctgcacagcaaaagaaactatcatcagagtaaataggcaactacagaatgggagaaaatttttgcagtctatccatctggcaaagggctaatatccagaatctacaaggaatttaaatttacaagaaaaaaaaacaaaaaaccccatcaaaaagtgggtgaaggatatgaacagccacttcgcaaaagaagattctaatgcagccaacaaacgtgaaaaaaagctcatcatcactggtcatcagagaaatgcaaatcaaaaccacaatgagataccatctcatgccagttagaatggcgatcattgaaaagtcaggagacaacagatgctggagaggatgtggagaaataggaacacttttacactgttggtaagagtgtaaattagttcaaccattgtggaagacagtgtggcgattcctcaaggatctagaaccagaaataccatttgaactagtaatcccattactgggtatatacccaaaggattataaatcattctactataaagacacatgcacacgtatgtttattgtggcactattcacaatagcaaagacttggaaccaactcaaatgcccagcaatgatagactggataaagaaaatgtgccacatatacaccatggaatactatgcagccataacaaaggatgagttcatgtcctttgtagggacatggatgaagctggaaaccatcattctcagcaaactaacacaggaacagaaaaccaaacaccacatgttctcactcataagtgggagttgaacaatgagaacacatggacacagggaggggaacatcacacctgggcctgttgaggggtggggggatgggggagggatagtattaggagaaatacctaatgtagatgacgggttgatgggtacagcaaaccaccatggcacatgtatacctatgtaacaaacctgcacattctgcacatgtatcccagaacttaaagtataattaaaaaaaaaaaatactcagagaagttccaaatgctgtatataaataaatacaaatcttatatagaaataggatttggaactatatacatgtatataaacataaaaatgtatgtttatatatgtctataaagagtgaaacaattaaacttcttctataaaaaaaagagtagggataaaaaggcatataaggcaaagtcattgccctcaaattgtttacagtaaagtggtgaaggcaggtatataaataagtataattccatgtagtttgtactgcattagaagtatatatgaagtatacagtcagcacaaaaagatcaagagttctgagtagaaggtcaagaattgtagcacagaagacacaatcttctggctcaccctactgagaagaggtgatatttaccaatgaattgcagaataggagttcactaggcagcgagataggaaaaggcattacaggcagaggaagccccatgtataaaaagtcacataagcacaaaatagcagggaaagcaactaattcaatatggcagggaatgtgagagggactggagggaacagggaaggctagagaacaggaagggtctaatgacaaagggaagaagcttgccctgagtgctgcagcattttgcttagaggatgttaaagcaaaggaggagattctggcagctgtgcggaagacggactgggatggggggccaggtagacaaagagacatcctaaggaaactgaggcccactgctaacacagttctcagtgtgcttaagacgatttaaccttgtggaaaatactgccaggaggatattttctaaggaatttgtttaccaaagaatctgaacccaatgatgaaccaatctttcgctaacaaagctagagaactcagaaccatctaagttagcaagtgttaaaacactggaaagcaaatgtggcaacagcactttcctatttgaccataatcaacatcaatgtggaaagaaaacaaacctgaaagcaagtgaggaaaacacacagtgggtttctttgctttctctccaggacactgtcagtacacagagcatttagaatagctgatttgatcgttgtgaaaatctacctgcgtgcccctctctctctctctctctctctgaatgcaattagagaagacagcttcattcacactgtgtctaaaaatagatgatggcagagttcacagactgacagctgcattgtcatacagtaaccaggaaaggaaagggatggctaatttaacttaacaacttccaaaacaaacagtgcagagggagtccaggataaagaaaaaacacacaggtcagttcttcaaagagctggcagagggatggggtcgctccatggcagtttattagtcctcccaaaatcctgacgaaaccagctaagtattttgcccagatctacccagagtccttcagacaagagctctggcagatgaaccgctacagagattcaggcaatattaggcagcagggccaggactttccctgctgacttcttcatacatcccctggacacaagtaagctaagaagagtcatgacgtttttctaggcaagataaataaatgagttttttccccctttgccatatctaaattatactctgcctagcctggggcatttaaaaaaaagttatccaggaaataaacatgcatcattaaggggcagaaaccaggtgtctaaaagaagcaaaccatttctttccctcccttcagtcctaaaatgttttctgttttcctcctcagtctgccttgcccagggaagggattacggttgggcttcaaaagaaacaagggaataatgcctgtggacgggtagcagattctctctgcagctctcccgcagctccatgttggctctcagcgctgctgccagccagctaaatgtcagatcacggcaccccaacattccctcactgcatacctccatcgccctggtgactaagctgtttcaacagctgtgttattgctggagtcaggccagtgttattcacacgaagtatttgtttcatacggcttatgtggggaattattgcactcagctttggggttctatttaaagataaggtccttcccttgatcaatcagccaggacattcctcgagttgggctccaggagacagtgggacaatattctactgccacccggggttccagataatggacagattcataatactataaagaaggtggatgaagcatatgtgtgtgtgagagaatgggaagcataatggaaaaccatgacccttggtggagctgcggaagaactctgctgctcctccctcaataaaagccacccacaacacaagagtgttaagctggactccctttctgctcttcttctccagccatcaccctcagcctttcccttaaaatcattgctctttcctttcgggtcacgctagcactgttgcgttggtctctacatgcatcactccacacacctgccccgaatgccatctcctccctcagcccttggcttctcctatctcatcaaatggtttatgaccattgatgttcctatcatgtaggaagcaagttgggcctgttggcctggtgacctcctccactactccacatcctcttctgagtgtgagtaagataagggctgtgttactaactgctgagttaatcaacccaaactcccttatatggagggacaactgggaaaaggaaaaggcattacatccatgagctttatgtcctgtaggtgggactaatttctatttctagctcattctaggctgaatctccatcaaagaggcctactggcctgttctccctccaaagttgttctcaccaagagcaatcgggcaccattttctgatgctgaaaagatctcagaaatatgttttcttataaatgaagtatttttaaaagaaataaaacaatgattcctaagagctcacattttttactgcctactatgtgtagacattttcacccatgcagatgccagccagatggaaaccatcacaggcaatttcaaagtgaggaaactgaggcccatggccatgctaccaatgtgagagggaggcaaaatgagaacccaggtttgcctgactcagcagctcaagtactttccccttatgtctctcagtcatggggtaggaaagttaggacacccgcttcttgctctaaaaaggccactatttagccaaacaatttgagtaagtcactttacataatgtattatttcatgaaatactacagttggatcataggcttactaagatcctttctagttctaatatttcatgaatgtagaaatctaaaacacctccagctgttgactgccttctatacttaaggcactgaggccaaaacaaagagctataaaaccatgcctgtcctcagggcacttataatggagtttgagtgacaaaggataacaagttgagtttgactaatggaagagttaaacaattaacaaatacaaaaataccagagaaccagactacagggcagtgcttgagaaataacaccgcataccagcatgactatacaaggagaaaagtagatttcaacaatggtaacacccctaacccggaaaatacatttgtgctgccagcagaaagaaaagaagagacagaaaacgcttgcaggaaaagccagctactagaagggatcccgtctgtttcacaggaaagctttgtttctgacaagtttcgtaaaggaaaaagtaggctagaacaagcttttttatttccaacccaccttttcttcgttcccatgaatgaggaggggatacaaatgagagcaggcagccagggacaaaaataatatggctggtggttcctgacctcttggattcctgccaacagagaagcctgagaggcaacatttaattgtggaaaaaccagcctggctctcctcttatctttttcctctgtgacttaaacccacaattactggcaacccctagattccgagtcacccagctggtggtggcagcaatggctgtgtctgtagctgaaaagcaaaagggagtcagattttacctgcctccgaagccagccctgggagcacagccctaacccagcttgatgacttctcccattaaaaggttcacagatgccctcccgttgggaaaaccaccaagtgagaagtccagatgggaaaaaaagaaacacgattttcagctgctgtataattcaaaggacaagctacgagtctcaaatcctgaattccacattttatttcagcactagagatgtgatgttcaattccttttcttaagaaacaaactccaaatttcttagctggtcatcaaggcaactcacctaccaggccctctgtctttcagcagctcatcttttttctctaatatggacacttttctacagcccaacaaatgggcttaccgtcctttgcacatatgttatttcagagcatttcatgatagaaaaatatggtcttagtcctcactttctcacctagaaatcactttgaagaagtcacttaacttccataatttcatacttgtttaaatttaaaactttttctccagtaacagcctcacagaggacagtagagatttaaccttgaacatctagcattgagcctgcagaggagatgcataatcaacgtttccttctctatacctaatgcctttgctgagttaccttcatccaaaagaatgttcccattgctaactcttgtcctgatcttttcttaccactcttccactccaagaggttgtctcccatacacctctgctcccatcttaatattcttccatttcaaaatattttaatttacatgctgctatgtttatagtcaaatataattaaatcatgcctgtgggcacattctcctaaggatgctaagaattttccacatcttctattttaggactttatccaattgcttcagtgctgatcagcatgcattttggtactcatggggcataccctcatcgggattcataaacctctgaattccatgggtgagcttcagggcttccattgaaatatgaatactaaatgtgcaaatggggtctatgcatatttgtctcccaaggttaaagtccttgacctgaagttaataaccactgtccggaagtaatgaaaggcctgtggctaacatccatggacggggtcctttttctgaacactcagccctgccacctatgtttctgggcttctatgctctctctggaacacaattcctcctttctattcaagtccgagaataataactactcactcttatttatttatttagagacagaatctcaaccaggcaggagggcagtggcgcaaccttctgggcccaagcagtcctcctacctcagcctcccaagcagctgggactacaggggcacaccaccacatcctgataatttttgtattttttgtagagacagggtttcaccatgttgctcaggctggtctcgaactcctgggatcaagagatctgccctcctgggcctcccaaagtgctgggattacaggtgtgagccactgcgcccagccaactattcacttatattgagcatttactatatgtatccagcacttactatgtaaaagcctcacatacactattctagtttaatccttacaacaaccctataaaggtagtactactattctattttataagtgaggaaaatgaagtacaaggaagtttcaaaaacttccttgccaagggtctcataatttataagcagcaggccaaacattcataatttatgattcagcccaaacactctggcttgaaagtacttaacccagtgctggagttgtctctccaagctctttcactttccagaaaaaaataagactgcccttggactgtttctttgccttcacattgtaagtgatcacagattccaacgcctttaaaactccacctttgactcaatcaaaacatttccttttccgtgagttaatcatttccccttctatgtttatggactcctttgggtacttaatgcactgaacacactggtgtaattttttaattctctctccatgaattagactgtgagctcctaattattttgagtacacatggaatatttactgtgcctggaattgtgctaaggatataacaatgaacaacacagtgtccctgcctttaaataattcactcttaggccaggagtggtggcttacgcctgtaatcccagcactttgggactttgggaagccgaggtgggcagatcacaaggtcaggagtttgagaccagcctgactaacattgtgaaaccccgtctatactaaaaatacaaaattagctgggcatggtggcacacgcctgtaatcccagctactcaggaggctgagacgggagaatcacttgaacccaggagggggaggttgcggtgagccaagatcacgccactgcactccagcctaagcaacagatcgagactacatttcaaaaaaaaaaaaaagaaaagaaaagagaaaactaaacaaaagagggttatgatggtttctgaaattgtattatgaagaataaggacttatctttatttcttaaatcctgagcaaaatgctagcatgtagtacaagtcccaataatgcctatcgaatgaatgaatgaaattgggaaagggttttcagatactgaactgctaaactgaaagatctaccatcccatcatgaaactctttgaggttatttatacactgactcacctaaaaactgcttcctgtgttggtgtctatgatacattttttaatgtcagactaaaaatacacttccagtacaccaaccctgtctgcctacctaaggagtagaaatgaacacaaggtcgcatgtaacaaaagaaaagaaaattcactcatttcaacactaagctcaccctctaacaagagcatctgtcttgactgagcactatcttctagaatggttttcacttgagggtctctgaagtcatctatttacaaaaccaaaggataccaatgagattttttataaagtcagagaatcttaagtgagtcatggactctcaacttcagagagttagagtagatgggaccttaggggtcgtctagtataatttcccactcagaacaggaagcactccatagccctgtcaatagactcatggtgggatcaaggcactggagtcctaacatcatgtacactcatagcctctcgacttcccagctgggagactggcaaatcatgtaaactctgtcatcctcagtgtcctcactctgccagatataattgttccgatgatcagatgaaataaacgttgtcttaattagcgaacatttgtttgcaagtaacaggacttcacccccactaacttaaccagaaatcagctggagggatacaggagtgctttaggaaaatcaagggcagaaaatgctgagaagctggagggtctgaaaccaggaatagaaagctgtcaggaggaaagtcaactcttatagtctattgtaattacactaatagtcttcatctccatttcctctttgcatctggtcttcccactctgccagtcaacaatcacggcttctctgtgcacgtgtagaatgatgactgcccaggtggctctcatggcttttcagtttaagtgctaataaaggtagatctcgaattactgaaacacaatttcttataagagagaatttgattgcttcccctttggccaagggaccactgctagtctgatcagttatggcttggggactgatcatatggccagttgcccattcagtagaggtggtggaacatgctgagggagggggaagttaaggccaagttcaggccaagcaaatgactgacaacaaagacaagcaacagcatctctagtgcgatggtactttgcaaagaaagcactgccccatgccagctatcactgtggccatccttatgatcctcaccaaccatcttctgcttgaccactaccagtaacaggctgctcactactggtagaggcaaccttttcatcagcaaacaacttcagctattagaactcttttccatgtgacagcaacttaagatactaaactgaaatatttgtaatcttctcccaagccttaactttaatgaaggcataatcttgcttgttaggtcaagcctgggcttttctttctagtcaaaatatgaataatgggcaaagcaagatgttgaggaaaagctgagtgttgggagggaaactgaggcagggcttgcataatgtctttgggaatgtgtctagacttgctggttccttacttctagccctcataggctcctaggctcctattcccattatctcaagtagcagaacatgttccatataaatgctaaaccatcacagctgtagatcatgtgcctgctcttttgacctccacattttcaccacctgtttctttgttggattaccaataaatagcatgggctcccagagctcagggccttcacagcctctgtacactagtgatggccccctggtgtcccaactttctctctcaaactgtctttttctcaatcctttgactctgctggactttgtcacccccacaacctggtgttgggtctgatcaccccaacacaagagagatagattcactatgcaattattttagcaaacaacctggaccagaacaaagccagaacctcttcttcctataaagaattactactatctctctactaacaccattactaatgactcactaaagcaaaagaggatctggaactgtttctagcatcagtgtgtagacaataggtagggttggggaaaatggttttttccaatgtagagtccctagcacttttgcaagcagaattctgccttgctctcatttaacttccttttgcttagaaaaatataatccagaaaataatcttaacttcatttttttaagttaaccaagataaagttgtgaattccccataaaagaacctcataatagctatgttatgaccagctggcatttaaatactgaaagacccaaagttagaagaggaggtgaaaacaaaaaaataccttctatacattgggggcaccattaagggatgtgctgcttctggcttctctgctcttcacattagtcaatgatgtcaccaggtttttattttagtaatcaggatatacttgtatggatgcaaagagaatatcctcatttatattctaaactcagagcaggaaatgagacacgtgggtgatctgcagctgtggcactataaacagggccagcctaccacctagtctagattctagactgcacttcattccctgaaatactgattgggagattttaaaaaattgaaaatatatcattttagaaagaccagtgcatcttctgtgcaaggatcttagagtccgctgtttggtagaaggctgactcacctgtatggggtggtgcacgtgttgttaggtaccatctacctatctacaccactgatgtacaacgaggagatcctgccctggctccagccagctgtgccaccgtgggcgagtaccacagagttcaagctttctccagctgctaaattaaaggattagtgctttaacttgggtcaaccacccatttgcaaacctgacaagaaccacaaacactcttacttcaaaaatgcatataagcaaataccactgaaattttatgtagagtatcaaggggttctcttagcccttacactccagtctaaactgcttggttgatgattgttagaccagcagccctctagtattcctttcagcactccaagctaaaataaaacagctgatgtttagtaacaatttctgcaaattattcaacaccatagaagagtgttttgttaagactagagactaatctaacacaatctactcaacaatgttaaattgaccagtaaccaatagatgactagaagaaagtgtatgtaactagatataccaaactatagatactaattttaaaatcttggaaaggttttggaggagccctactgtttctgaattggaatttttcatttgcaaatacttaacaaaacccaccaagccagatagagctctatagcgatgcctatggaggagccttataatgatgttgtccaagtaatgtgcttaacaataatcacactcaaagccaaaggttcccatgctcctgccaatataacatgctcacaacggtcaattccaaaggaagagctgtcaagaagtgcctgaagatttcctcaaagggagagataattcatgagcaaacaaacatcatgtccctaatcttctctatcctggggtaaacaaaatatagttttctcccatgatttcagttgctttctataccaagtcagtaagtaaaactgattcatactggtaacttccaggttccagccttggtttgaaggggcacacaattcaataagagtaaagaagactggccatgtaagcccatcttgaatactgacaacttccgtaccatttacctaacactacaaaccctactccatttaagtctctgagatctttttgatgtattttgagcttttcaacttgccttttttggtgggagaggagggaggaggagaacaaagggagaatttgaagtttttatttctgcttgcattgactcaaattgtggtaaagaaacttaaaaggtaactttaaaattctagtgacactagccaacaatgaaaactatctaattagaatgttagaggttttttttgtttgagacagagttgctctgttgcccaggctggagtgcagtggtgcgatctcggcttgctgcaacctccacctcccaggttcaagtgattctcctgcctcagcctcccaagtagctgggattacaggcacacgccaccatgctgggctaatttttgtatagacagggtttcaccatattggtcaggctggtcttgaactcctgacctcaggtgatccacccacctcagcctcccaatgtgctgggattacaggtgtgaaccactgtgcccagccaaaatgttagatagttttaacacaggctataacatagtcataaattaaagaagacatggtcgtaaatgaaagaagacctctttttggtgggagtagtagtaggggtgggagagtagagttatacatttcttcttagcagttgcttcaacatattttattaataaggactatctgctgaagcacagaaatacaattatgtgaatatcatactaccaatggcctgttccatcatagcagggatagttcttatagtgtataaaatcctctgccccattcagctctctttatggagctttcctcagaagcatcagaaaacacagaattaaatatcacaattcttgttgaaggccaaaaattagttcccagaaggattctttgactttcatccttctacaaattcacccatcaccattgtagataatgtgaggggtgaatttgtagaaggatgaaattcagagaattgtttatgatcaatagattgttccctttattccagttgtcttcccttgatgtccacttaacattccataataaatggacaaatggaaaagcacaattactctgccaaaagtcagtcaacattctcccaggacactcagccatctaacttgaaaactgactggtaataatatcattctaattactttaactagaaatttgttatacagaaatgctttcagtgtggggaaagaaaaatcacttgccacttatagaaagaattctgcttcatgtgaccatttgcaataatgaaacaagtaagacaacactgggttccagtgtacagcacaaggatcaaggcgaaacataatgctttcattacgtaagaataggactgacattattctggctttcccctacccttcatcatttaccaatattttttcagtctcaggaatttttcaacccctgaaactcctagatttactactcaagacacagctatccatcttgaggctttctgccaatggctctagtgcttctatttcaacagcttatagatttgaaagctggaaagagagatatgtaaacaaattctctaactttgatctatgcacccaggtttctcaaaagaagcccttggagagtctggggtatactaagtgtatgacttgcagttgtaatcattagagtgacaacccatttccagtgggtaccgttttagccaacccaaacctttcttttcctaatgcatagagtgactttttaaaaaatggtatatttgggaaagtattttagaatggcatgttaacaaaacaaaaacactctagaatatattttcaaataacagaacttggccttaccaagaggtctaataccatcaggtaaataatcatttttatcagtgattcataatacatccagactctaaatgttaaggctgacttttttctgacactcttctctgcctattcatactccatttcctaactcctttagagtaaaaattgaaatcccatatccctaacaactagacagaagcatcatgtttacatcctgacaaattcattaattctgtacctctgaaatatttagcaaaaagccagcactgactcaatcatagatttccacagacaggtctgttcatatttgtaattggtattcactgaaaggtcaatgactcctgttcccaagtatctatgagtctctagattttcttaattggcctcttttcctcagctcttacagactattgttttaaaactaccaccatttagaagttgaactccgagtgaggggaaaaacaaacaaacaagcaaacaaaaaaaacactttttgattcccactccactcataatcaacataacacagactacttctgacccaggtgtgatggaaggagcggggcacagagtcgggggaggtttctccacacaccaagcaagcaatcaatcacttccacagcagacatcagctgggtgtccaaaaattcaattttgacaccacttacctggaaatagcatcaagtctcataggttgaaagctcagtcccataagactgctccccacttcagatgcccatcgaaaaaacaggttgtggcctgttataaatacgcgttcccatgaccctcctccttaggattgattgatttgctacagaggctcacagaactcagggaaacacttaacttatgcacgttataaaggatatgacaaaggatacacatgaacaaccagataaaagattgatagggtaaggcatgtggtatggcagggatccctgaccctctggcagcagacaggtaccagtcagtggcctgttaggaactgagccatatagtagggggtaagaggtgggtgagcaagtattatagcctgagttctgcctcctgtcagatcagctggcattatattctcataggagtgggaaccctattgtgaagtattcatgcaagggatctaggctgcatgctccttatgagaatctaatgcctgatgatctgaagcggaaccatttcatacccaaaccatcccccatcccctcatctgtggaaaaagtgtcttccatgaaaccggtccctggtgcccaaaaagttgaggatggctatgataaggcacagagcatccctgtcctctctagggtgccatgctccgggaacctctgcaagttcagctgtctggaagctcccagaacccagtccttttgagtttttatggaggcttcattacctaggcatgactgattacattattggccataagcgagtgactcaatctttaggcctcttccctcctggctgttggtgggtggggctgaaattagttccccacccttctaatcatgccttggtctttcaggtgaccattctgaagctatctgggagtccccagccatcagttgactcattagcatgcaaagaggcattcctatcactcaggagattccaagaattttagaagctgtgtatcaggaaatttattactataaagtaccttataatgccatcatttttctcccaaaggcactggcttgattaaattcagaaattaaaacaatggccagcttctatagtgtaagtcaatgcttttctagttttctgagggtttggaaactcaaatcctagctaaaacctgtatcacttttaaattgaaaaatttaaagggaataaacatttaaccccaagtgactagaagtcatttaaaatatgtagtacttagattattttatctactcaaagactcttcaaaagtagatgaaaacactaaccagatatatattataaacccaagctttaatttcagagcccaaacatgaaatctcttctcattgtttgaaatctgaaactcatttcaaagactgccacgaaaagttaaaaaaaaaaaaatggattggtcttgacttttccttacatatgaagtaatattgttacaggtgaatctctgataagcaggaagccatcatgtgtaataggatcttgtttgccacactcccaaactcttctctgaagtcctgttcattgctgtcagaaaggaatccaaagtaatgataaacaatataaaaagtagagagtctcatgcattcttaataccaaaatcagagagaaatctagacctgatgtgcctgttatactaaaacatgtgtgtatatgtatattgctgaatatatataacataatatatataatctgtataatcaatgccttgctcagtgtccataagcaaaggtagagaggataaatttaaggaaatgaatattcccacaaacacaacatgtaacttctcatataatagttagcagctggccaggcatggtagctcacgcctgtaatccccgcattttgggaggccgaggcgggcggatcacaaggtcaggagatcgagaccatcctggctaacacggtgaaacctcatctctactaaaaatacaaaaaaattagccgggcgtggtggcaggcgcctgtagtcccagctgctaggggaggctgaggcaggagaatggcatgaacccgggatcgtgccactgcactccagcctgggggacagagcaagactccatctccaaaaaaaaaaaaaaaaaaaaaattagcagccaaaatgtgttgctgctactcatgaaaagtattttttggtgtggttttcttgatagctctattaagaaagttattttatacatttatcaaatgaataattagtggtccatcttgttaactttttagtatgccccctattaagtgctagttctcatgttataagaaaattaaggattatttttaagtcagaaagcttgagtacagtatttttgtagatgaagataaaatattttaaagcatgaagatgtacatgagaaaaaaataagacattaatatttatatatagaaatgttttaaagctttgccaacatgggcatttttgttgtttaggattagtatttgctgggaagtaattcatctgtgaaattatttaacatgtagaattatttcttagtttctggtttgggagaaatgctcaagagttgagcttaaaatcattttattcacactgctaaagctgaaaaatgtaaacagggagctttcaatacatttcaaatgagtttggagaattctaaaatattcaatccatttataatgaatacaaaacatcattagaaactggcaaaaaaaaaagtagctaaaagtattcgagttatttcacattactgggaaagtttcttttaaaaagttcagttataaataacattcactaaacatatttatccttttttcaattttggtggtataattttagaaatttatcgttgacttttaaaatttcacctaaacttacctgaggctctgcattatgttactcaatgattctgatgccaagttttgaaatcaaattataggccagtcaccttcagtgatgtaaaaggtagaaccacaagataatccagcactttcctcacaacctgaaaacggaacctgtggcaagtacctgcccaagtgtcagactatgctctaaacaactgcctgtcatgtaacaggctgctcgaaagcagcaacatactactcctatagtcaattcttaacttcttaaccacaatttcatcagtgtaaaaaatataggagcagtggggaccagacttacatatactgaaatgttaaacaacagaactcttattttgaagtgtgggaggggaggaagcacctcaatcagttgctttatgttccttttagtggcagaagaatgatacaatccagtattttcatccacagctccctaaacacaaagctgtggatttcataaatgtaaatatactgcgtaatctgcccactgggagttcatagtttagtaaggactcagagaagacaatttcactgtgcagaacacaaggctgataaagtaaacatcacaaggccagtaatgaagaatgcgtaaggaaagacagattatatccaggaaggaatgaggacgggagataatatagaaaatacctaggaaggctccaggggaatgtaaaatttgggatgttgtgaagaatgagtaggtttatctgggaggagcccttcatttgtgagaagaggaatcacaagagaggaagaggcaggcaggatcaatatcagcgaagacgcaaagggagaaactctctggatgtgtttacagggcaggaaactactccttttgaggatgcagagaatggttactggccagcagtgaggaaggaggctagaaagaagccttgagccaggaagcgagaggactctgaacaccgagtcttatttgttagtcactgaagatgttttgagcaaggaaatgataaattaaagctaaaagagtctcctccttatcagaggtttcaccttcagtggtttcagttagcagaggtcaatcacagtgtaaaaatattagatgaaaaattccagaaataattcttaagttataaattgtgcactgttctgagtagcatcatgaaatcttgtgctgtcccctgataagaatcacccctctgtccagcatctccctgctcctgcctgttagtcacttagcagccatctaggttactagatcaactgctatgtattacagtacttgtgtgcaagtcatccttattttctctcattgccccaaggtgcaagagtagggatgctggcatttcagatgtgctaaagagataagtcaagtgcttcctttaagaagatgaaagttctcaacttaaaagaaaaaaaaatcttatgctgaggttgctaagatctacaataagaatgaatcttctgtccttaaaattgtgaacagtatattttttctttcattattaattattgttgttatcttttactgcacctaatttataatttaaactttattctaagtatgtatatatgtataggaagacacatcatgtatgtatatagggttcagtaccgtgattttaggcactgggtggtcttagaacatatcccctgtggataaggaagacttacctctaccacgtgcttcttttataaagactaatctcactaaccaaggtgtagaagtaagaattggaaaaatggctgaatttcagcaataaggataaatataattggataattgtaatagctacttttaatttttaactgttttaatagtacttactatgtccaggctgggtgcagtggctcacacctgtaatcccagcactttgggaggccgaggtgggtggatcacctaaggtcaggagttcgagaccagtctggccaacatggcgaaaccccgtctctactaaaaatacaaaaatttagtcccagctactcaggaggctgaggcaggagaatctcttgaacccaggaggcagagattgccgtgaaccaagatcatgccaccgtactccagcctgggtgacagagcgagactccgtctcaaaaaaaataaataaaaaataagtacttactatgtcctaaaagttttacataaactaatttattccttagagtgagttggttaattaggcattattatccatattttacaagggaggaaactggctaagagcggttctgtaacttccccaatactgcagagcttttaaaaagtggcacaaggatttaaacccattgctgtaggactcctaagtccatgctcttaaaaaactttctatcttaccccctaatctagatataaatcagggatcacatttcaaatgaaactgtgactccattgaaaagtatgccagcaggtagtcagcctctaagatggtccttaatgatccccatctcctggcattcatgctcttctgtaatcacctcccttgagtgtgggttgaacttactagttcacttctaaccaacagaatacagcagaagtgatggaatgtcgtttgcaagattcagcggtttccctctccagcactgctcaggctctctcttggctcactatccctgggggaagcccgctgccatgttgcgaggcagtcttatggagagacccatgtgggagggatggaagcctgccaacaaccatgtgagagagcttggaagcagatcccccttccccggtggagccctcatgcctgatgagactgcagaccaggccaacagcttaattgcaaccttgagagagtttgagccagagactcccaaactagattcttgacccacagaaatgaggagctaagaaatgtttataggtggccaggcacggtggctcacgcctgtaatcccagcactttgggaggccgaagtgagtggatcacctgaggtcgggagttctagaccatcctggccaacatggagaaaccccgtctctactaaaaatacaaaaattagccaggcgtggtggcacatgcctataatcccagctactcgggaggctgaggcaggagaatctcttgatcacgggaggtggaggttgtggtgagccaagatcgtaccattgcactccagcctgggcaacaagggtgaaactcagactcaaaaaaaaaaaaaaaaaatgtttatagttgaaagctcctaacttttagggtaatttgttacccagcattattaatacagtcagtagacagtaattatttattattacagggtaaatctttttctttatacttggagctagaagtagggatctgtctaggagagattatacctgaaataaccacaaccagcccaaataacagaataccacgtcctttacctttccacccaaacatacataaatcaggtaatctacctatctcatcctcccatggctcttcttgttgtccttattctcctttgcttgaatgcattcttaggaatagaaatgctaaaacccaaacctgcaggtttcaaaaaaaaatttttagacatacagttttgaatctcatagcaaactctttccttcccaaggctcctcacattacattgtgtattcttattatagcacataacatgttttttcttatttgtaggtttaagtgtctgttttccaggcaccctcttccctaacccgttacaagaatcatgtctcgtgtgatcttatatccccagtactgagtgttcgtatggctgggacttaataaagtttaaatgaactcatgaataaatgtgttgcacaaccaatgagtgagtgagtgaacaagtgagtcaataagcaagagtttagggacatgggaaccaccacttaaaagcttgaggctgttgtgcaaatttggaccttcatataagccatttccttctatatagaatgctctttcttttgctcatcctcacctcctcaccaggcttttctctctttaacattcacctcaaagagctgtctgattgcctctctacaactctccccgccaacacacacccacacaccctaccagggaagtcttccttttctctgctgtgaagccttttctttaagtttccatatcctcctgggcataacttggtcacagcacccagcataccacactgtaatgattagttatttgcctgtcatttccacttagccgtaagttccttaaaggacagcatattcagctaacagcagaatgcctagcagtggtaggcactcaaaaacagtttaaaataatgggcaagagaatgaatgaatgagaaaaagaaaactgtatctagaaaattatctcagcacaatctatttatttcaggtaagctatcagtcaggtatacatagtgctccaactcctaaacagagtaaaaataattgtacatcaagattattacagatacatgaaaatcatatttagaaatagtacttcagatcaggcatggtggctcacagctgtaaaccaaaaatttggggaggctaaagtgggaagattgcttgagctcaggagagacccccataaaattttaaaatttaaggccaggtgcagtggctcatgccagctactcaagaggctgaggtgggaagatcgcttgagcctgggaggttgaggctgcagtgagctgtgatgacaccactgcactccagcccaggcaaaagagaaagaacctgtcacacacacaaaaaaaaaagaataaaaaattacaaaattagcgtgcctgtagtcctagctattcatgaggctgaggtgggaggatagcttgaacccaggagttcgaggatgcagtgagctatgattatgctactgaactccagcctgggccagcattcgagatcagcctggggaacataggagactctgtctcttaaaaaaaaaaaaaaaaaaacagaagaagaaagaaatagttttcaggccaggcacagtggctcacacctgtaatcccagcactttgggaggccaaggtgggtggatcacctgagatcaggagttcaagagcagcctggccaacatggtaaaaccccatctccactaaaaatacaaaaaaaaaaaaaaaaaattttgctgggcgtggtggtgggtgcctgtaatcccagctacgtgggaggctgaggcaggagaatcacttgaacgcgggaggcggagattgcagtaagccgagattgagccactgcactccagcctgggcaacaagagcgaaactctgtttcaaaaaaaaaagaaaagaaaagaaaagaaaaagaaataatgtttcaatctatggacaggccctagacagagctgcctttaacacatctttttccctttccctcacatccttgatcccatctcagtcaaaaaggaaaaaacaaaaagttttcttacttctcagcctaagattcctgatactgtccccagatgccatacatgtattggcctcccagaaatcacccagtgattttctccccatgaaaagtttatatgtctcatgccctcagagtttttaactgcaaataagctaaaaaaaaaaaaaaaaaaaaaaaaaaaaaaaaaaaaaaaaaaaacgaaaaaaaaacctggtttggtggggaaatgggtgctcatgggttggcatttccattttggtaggcatctttttctaaggccatagctttactcaaagcccagtggaaaaagacatttaaaaaaaaataaaaacctttcaggaaccctcaagtcactccattggggtgaactcccctgtgacactagagaggtggtgaagcttggtggttagggcagttttctgagtcagaaatctcagcttttccactctctagtcttcagatcatgagtaacctcactggtgcccaagtgttccatctgtaaaatgaaataataagactacctcaaggaacctggtgggaagattaaatgggttaatacaggtaaagtacacagaaagtgcctgggaagtagtcaataattgtttgctattactattaccatttttacttttattagaattggctcaaaaagaacccaaagagggcaatgctcaaagggaagaaagggatgagaggagagtacacttaactgatttggttgtttagcttgaaggcaatgtccagctgcaggataaacagcatgaattggaaccaaggactcatctccatgtgggggaggggaatgtgaacagaaaacacgatgtcattggcttcaatttcccttggaattgcctcttcaatgtctcggatcttgtcacaatgattgggtccccaaggcacgaaccattttgtcttgtgatggttcttacgggcatccacacatttcaccgacatgtaggacactgccgttgtgggccctggagctgaaaagagaaagtttgtctgttttagaaaagccatctattgaaactactgtttctggttaatattctttccactgctgtgttccctccagcttttgtatcgccttctacaagtggggctcagcaatacttagggatcttccaaatctgggtgaggatctttcactgacctccagaggtgtcataacagtatctctgagaaccttcccattatgttttcaattgctgtgaaagaatacatttgtaaccagtctagttatacttccccacttcaaaacaatgtcacaaaaaatcaactgtgctacagttcccacctgattgaggtcttggagagctctggtgcttcatagagaacagtatctaaagtcagaagaccttagtcttcaaacctggattcgaagcctggttaaaaacctactgtcagtgaatcttgggtaagtcagttaaatctgtaatagcttcaggaccctcatctgagaaacggaagagtttctaagattccttttggctctaaaattgtacaacattgcttttgcttaagataaagaactaggggacaccagttagcttggtacctagcagagaatgggaactcaaacactgactgatacttcaaaagtgtactaaaatataaacgatgcacttcaagacagcaaagcaactttgaaatgtgtaactttaaaaacactattttgtgattatataatggttatatgattataatattaataacttggaaaatacagaaattttaagttcaaaacaacatttacccaaaatcccactagagggaagtaaccactgttggaaaatgtcaaaatgccatctgtcttttctatgactgtgtaattagataaaaagtttacacatgaattaaattgtgtaactttaaaatatacgcaaatattaacacatatttataaaatagttatatcatgcatagttttgtagtcttttctttttattcacttagaaaagcagagtattgtgtgataacaccagctctggaggcgacctgtctggtgtcaaatcctggctctctcatttttagttgtgtcaccacaaatccacactaggaaagttttgggcaaattactaagcctatctctgtatcggttttatcatctcttagatggcaataataatagtactgatctttccaagtcactgcatattttaaacaagttaacatatgaaagcactcagagtagtgcttgggcacacacaaagtataaaatattagccattatatcatattttctttataattaaaatctttcagttagtagttgcaaaatagtcaatcacacaatacaccaaaatcaacttctccttcatcagtttgtaaaggctatctataagaataatcctttgcctaatatgttttgttggaaatttctcctaaactttccatctgctatctaaatttgtttatgcacatttaaatagagaagttccagatcttatatggaatccctcttttatgtttttccccccatgcttttgtgtttagagaaactgaccttcttcatctcaaaattcaatagtcatctatattgacttctatttattttttgcaatttcattttttctaatatttaaacagttgatccatctgaaaattgctataagagatgcagtgaggttctagttttatttcttaaatatttaaattatagttgattgaacagaccctcccttttgttgatttatcatatcactgttaatctttatgtatgtaagcatgtttctgaacatctgttcttttccatgcattaaactgtcaattcacgggtcagcacaacattgctttgaattttataaatttattatttttatcaatatctgctagagtaactctcttccccaatccatttcaaatttacatctttttgctaggatattgaagattaaattaaatttataaataataaatatataataataaattaatgtggacagaattagcatccttccccagcgtttagttttcccatccaagaacagtacttgtttctccattgtctacaatctgtttttaaatttcttggaaaactttcattgttttctttatgtgggtcctactagtatattttaaaatagatacatctataaacctttgaaagttagtagttaaaagaaagtgtcatcaattatggtttatgtgtgtggtttaaatatgtgtatttctgtgcatctgatacttggtatattatgtttgcagaaattctctcttatttaatagagatcagatagcaatggagaaacatgaaaagcaaaaagaaagttatataacgggaaaaatgtgtattattaatattctgccctacttctaatgttcgaatccacattatttttctattctattaaacatctattttaatgatacatttttagtaaaatgttatgtttgtaagaagttaggacaatgcctattaatacttaccagaaaactcaacactactaagctctagctgaacatccttcatgtagaaggctgaacactgcaatacaagttgccactaacccctgctacagacgtttttctttaaaactcaaaactgtatcacgaagacctcacatctaatccatctaaaatcagacatctgacttattcttagaaatatgagtcaatcaaactttggttatcctgactcagctaaatagcccactgacattagaaaagccaaatggcacatttaactgaaccctttttaatgtggttggagaaataaacagtgagacaaaagtcatgaattctattttcggctaacatactcaaactgactatttgctgcagaaaatagttactacattttaaaacttctattcttccaaaatgaacctaacctttttttctttattttttaccttcttgaaaaacaagtctctcacttctcaggccaaaacgaaaaataactagctgagttcctcagctaagctccaaaaccacattccaaacttaataacagagaagctgaacactttatggtcacaaagtccgcatttttaatgaatgcagtgaacgcctgcctttttaggggcctgcattattttcatcctctcattagtctagtgtttcttctataaagaaaaaaaatcccagaaatactaatattttcataaatatcatggcagtgaacttggagaagcctcaagtgcatctcaagctatactgtgagaatcacaatttttttcacttgaataaattagtccttgagtctcaaaaatgctttccataacttcaaaacctgaagataattcaacattttccgtttttctaatagtgttcaaaagagaaaacacaagtattgcttgagaaagtaaacagacatcctgatattcaaacatggacagttaatgttcccccaataatatatttacagctcagtgcaatgtcctactccagctaaaagtgaattcccaagtgtttctttatatagacagcattatcacgtaaaccaaaagcaaagcttacagctggtagctggtcacctaccatagaatgtgttttcattagctatagtcaaaattttagctacatgggtcacaaattgtgtctagaatcaaaaaaagtttgatctgtctgtaaatttttttaaagtgtgtgggattaagagaaaagagctaaatggaggaagtttaaatcatcttcaacctttgaacaagccacaataacaggtatttgtaatgaaggccttacttagtcacttgcgtggttctagggattaatagagtttgtgtattcaagagggggctggatagattcaggtcaacaaactgagtcatgtttgctcaggtgaaagctaaaaataaccactccccagtattcctaggagagtaatgcaatattacccagctgcctcagcacacattataaatgtctcctccacccacccatagtataaggtttaactgaaaacaagtaggccaaaaactacttctacaccagaccaattcaatgacagaataatttggccaaaactaaatatgcctagtcactgtaaactggttaactcatggttggttaagatagccttgggaatatgcacagaagttataaaaccatgagctattcattgaaaatgcagtccattatgaattcagttctttttactttatcaaacatgaccattttattttgtctgtatttcaatacagtatttttggcctccacttttccactacagcacatgaattgtgaaatgtgattctatataacatttaatgttaaagtgatatgaaatcaataagacttctaacaaattcaaggtgtgaagaaatgtacaaacacaacctgaagtctctatgaaaattcagtggtccctcagttacacacattactatggctcacagtatattgtccaaatttgtcttgagtatctaccatgcactagacactgccggttctggagtaaacctgataggcaccaaccatatggaacgtacaaataacggaggaagcagacaataaataaacaatttcaggaaaaaataattttgatgaatgttatatgtaacctgacattccctgagaaagggcaacagtcagatatttgggaggtgggagaaatgaatacaccagaatgacagaaaaatccagtcatcgttacaacataaccttgaataaaaatgtaagtgaacaatgactaaacctgtagtacttcttttggaagaatattcattgactccagtcagcttcctgttatttcacttcaaatggctatccagtttacaaattactatctagccaaccgctagcatttatcatgcttaaaattgagtcaacattaaatcattagcccctattccttccagaacctgtaatttaagagttagagagagacaagacttggttgcctcttagaaaagttaaaataaaactaaaacaacaggctgacatgacacattgtctccatttaagccaacatagactatttatttctttgctttattatgagtaatgaacatttctttagcaatcacctaggagcattactattatgcaggtaccgtactaactaaagacagagacgaatggcctcccagacccccatttgctcacaggctagtgtgggaggctgagaagttcacaaagaattacaccctgattggaaatttctttgacagaggtttgcacaggatgctccagttgtaaaaagagctgagggtagctttcggcagggcttagccttggaagagagcaggtaatagccaagggagaatgggggatggccaaggagggaaggtgctgaggtagagatagaacatgtgctgggtcatagaatatctaaaacaatcatattttctgcagatatctgtgcttgaatattaaaaattaaaaagagatcatttaacggtgaaaactgtagtactactcttatctctgtgtccacccttgccttttctaatcagtggtataattctactagagtgccttggcctctgctcccaatcatccctgctgtactctatagagcaccataaagaaggaataataaacagagccacacataacaaagaacttttatttggcaggaatgtttccttttatgacacctatctctgccctgtaagtagccacaaggccagaccagagatctgctggaaggaggcggagtgagagggtagtcaggtgggaatgaagaagctccccgtcctattcccacaaatggccccaaagagcctttgaagtctcagtcatcaggtaataatagccttcctctaaattagaggaagaatgtctgccttgcaacaaagatgatatttaaagaataatctgctttggggtacaaggggaaggaatgcagagaatagaccagttgaaaaggtaattcctgtttataagaattaataatcagaacagcaccattttaaaaagtaatgacttaaagtaaaaatggtcaaagatttcagaaatgttttagagaattttatgtttacaatagaatttatctaacaaaaatgataggaacaatacacattgatttaaaaacatacaaaaagttggtagcagatactttctcctactgacttgagacattgatttaacacctgaaaactaatctcagttaaaaagctgccagcaccatctctccacctgtaaaaatgtgaatatttatttatattttataatttcattttatttattctctatcttgttccataaaacattttggggtactagaactggttattagcctttattttttaaaaataattgggactgatttcaacggatagaattaatgttggggcgggggtgggcagagactacaaattacttggtctatgtctatatcttcaaaagtttggggagcttatattctccagctattgctttttttttttttttccagctattgcttttgaaacaacagctgggaaatataagctcctcaaacttttgaagcaatagctgaagaatgaatataagctcccaaaacttttacctgatctatgaagttgaatggctcaatatccattttactttgaaatgtagagaaaacctccattgcactatgaatggtatttataagaactaaaaggcatatgcccaagttggttctaagctctgcctatctaaatatctctgcttgccttatgagaacttatataaaacatattgagcacttaaacccttgggcaattgcagagtgtgctttggattttttgagtatcaaggtggggagggtcgaaaagagggagaaagggaacacaggtgtcagaaaagactagatgaattcctgttatgtaactactttttcaaatgcccccaaagtacttatttaacctaagaaaatctttagctaagtttagaaattagctttaaatatgctcaattgattttccttagacattccacatgcctttcgccagctcaaaagccttaattctggttaaaaggaaacatgtgaaatatactgcacaacttcagtggccagatcatattaactggctgagctgtgaggtcttatgagccaaacctgcttaccattcactgaaagtcagttcctaaaaagatttcttaatatctgccataccacttatctaagttttgggtggctaattagaatgagctcttcaaaaagttcagctaaagaaagtgcaaatatttgcattaaattgacttagtacttaaatgattcagtgtgttaattcttttactgaaattgctctgaagttatagtagacacttatgctttctccaccacctactttgaagagaagattctcctatatttcaaccatacccattaaatcttactagcttactaaatgaagtattatttcacaattcaatctcaattactggagagctgaaagtgtgtctacagagactagaccagaagtgatttttacaattatcaaagctatgcccttgtgcatgaaatggggtacgctaagtgaaatgaaattcattcttgccagccactttcagtcagttagttatgctaacatctgttctaggaaagctaattttttttaatacagcagaacattcctttacactgaaccactaccaccaaaacacaaacatacatactacatagcagagttgaatgcaaaataatttgtaccgtacacacaaaagtcaagcacttatttaaaaatagttctttacaatataaacttatgaaattatggacattttgacagcaattttccaaaaattgtagcaaacacttgtaaatacattccgactcaaaaatattgaaaatatcatatgtttacattttaggcagatgaggattttaaatgcttcgcctacaacctcaattgttgtggagccaaagatgcaacagctttgaagaatagaagaattactctatatttgtcaggatctacgtggcaaacaagcgccacttggcttacattacttgcctggcttggatcccatggaatggaggagcattggaaccaagaggaaaaaaattaaagtgctttgggacagcgagccaaactcttacatagtatttgaaatggtgtggcaaacatgaaattattttaggctcaagattggtgctagttttttaccctctttttgaaaaaatagtaaaatgcacataaagggccctgccagaggtttagctcataaaatctgccaatcattggatgtgctaattggtgtagcaatccagtggtggcctggattaggactcaaaaactgacccttaccacccttggtgtcctgcagcaaagacagcctaaatcgaaaagactgatggaagtatatcaaattacgaatttctctatccctgaaaaatgcctgcaatttctgtttctccatcactccagaaatactcaaaacagcaaaaattaaatacatatgaagtgaacacaaaagacctccacagaaaaatcagtggctcatctgttgacgctattgctcattgctcggctggccagtcatctgggctaagttttgactttgggccagtgcttcaaaatcagcaacctttcagccaaaagactgtggaatgcagccaagaccacctgtggaaagtgaattatagcatctttaatttactaccttgggctatgatgtcagaaacccagcatggagggcgcaccagttcttgtgtgggaaatctctcagagcccccatggaggcccccaaagtggctctggcaaagctgtaggggtggaggtaacaaaaaaggggacacctggctctccttcttaaatcagctcaccatgggcacacatttatattggaattttagggtcagaaaataccaaaattaaatcttctagaagaaacacagtcagtggctttgctctaaagtgcctattacactctacaagtttccaacatttgttatttaaaataatcagacatttattattcataaattacatatattcttttatcaatattattgttaataataaacatgaacaactagtaagtgaattgcaaagaactttcacatacatagattatcgaatccacctagttaacaagtaacataattagcaccattgcatattcagaagatcagtggtttttgtctcatcagtaaatagagttaggactggaacccaggtctgatttcatatctaatgctcctttccaatacaactatctgtttatttattaacggttactatttattagcactctcagattacctgagatagttgcagagctgagggatgaatgaagacgactgtggccataagtagcttgctgaagctccacaggcaaggcactaccagcactgggctgggtgtcactcaaagggagccagcaagatagcttttctgggagacttacagtcagggacagagtacctctaagacttccataaagaaatgatggagtaataggctcatgaaaatgcactaaactcccttgaatctgataccctcccagtttttaccgggtcttggttatgacttcatattgcaggtaggcagtgtttaggatgttagcctagagaagatctgactcaggaacacagcgctgccatggaagtctatgacagcacttgcaggcatagtgagagacaggaattcaagttagagaaaatctgactccagagcaacctatggaagaattacttataattcaggtaggcaaacaatggcacagtttgactcaggaaagggtgggttcctcaaccatggaaacatttgggaagtaaatggatagataagagcaagagcctgaactaaatataagttcctctcagtcacaccaaaataagtctcctatccatgcatatggtatgtcagggaatggagaaattaaggtccaacaaagagctgcatatagtttattgatttgttttctattttctgaccagttccagataaacagataaaagcaattaaagtacagggcattctgaatggtcaaaaatttagtattgtacattgtaagttaaggctaagggcaagtaagacctgttaatgtctttatctggaatttcacaaatgccaagaataatcatatttccttccttgattgattattcaaagaaaacacaggcccttataatttgcaaatttcctagaattgagggtagaggtacattttaagggtaacttgcagttttaacattcacattcttaggaattattattattattaatttttttttttagacggagtctcgctctgtcgtccaggctggagtgcagtggcgcggtctcggctcactgcaagctccgcctcccgggttcacgccattgtcctgcctcagcctccagagtagctgggaccacaggcgcccggctaattttttgtatttttagtagagacggggcttcaccgtattagccaggatggtctccatctcctgacctggtgatccgcccgcctgggcctcccaaagtgctgggattacaggcttgagccaccgcgcccggccggaaatatttttttaaaaaacattgaaatcacaaaattaaatagtctatgcaattatttagtattttaaatttcatcagttttaggttctagctcaagggccgtctctccttcattcaatttgttaaatgcctatagtgtgccagctggaggcctcctctgattttccttcagttgacaaaagatccttacttcctttggtgccagtatcacctggtctatgtctttattatagcattctactttatttgcaggcatcacttctgaaccctacaaaattataagctcctaaggggaaggactacatcttattctgccttgtgccactaagcacagaaacttaaacatgcaagtcctccagacctgaactgaactatttattatatggcttttgtgtcataataaacatattaatgtaagttatgctcaatgtaactaacaaaattttatcaaatgcctactaagcatcattttttaaatgccatagtggattaatccttgtcccgcctgtatcaaagtacacttagactggcactcagtgacagtttgggaagaagccagagctgccttccgtgaggtcagtctcccaaggtcacacatgtgctcatcagagactcacttcctacaaatacttatgacggttcttccagatccgtgtcaagcaatatattaaatgaaatactgaattttgaagatcaaaatgaacttttcctaaactataacccaatccacacaagtaatttacacatcaaaagaaattagatagtaggcaaacaaaacaatggtaatttttttaaaaaaaactgctcccaaagggtttgtggccaacattaatattgcaggaacatgtttagataactgctgttcagcatagttcctggaaacaggttctcaaagccaggacttacagttatttaccttcttccagcactgccctgagggttttaaggcctaaatgaatagaaagcaaatgggggacaaaatgaaataaaatgttcacatctcagcctttagtgtatataactaatgtttgaagattttatgacaaaatgtgtcttcttaagaacacatgtagggaagattttggccatttctttaacaccctttaaacagtacctaccagagaaaaagcaaacactcccttctaaaagcatcaatattctacttctgagatcaaaactacaaaacaggctcagacagaaacctgggcaaaggaaccttctgctgcacgtatgtactatttcccagagatgtaaatgatttttttctctctgccccagtgaatcacatatgaaagttctcaaagaattagtaaagaaaaatggtgaaaatcttcttggtgttgaaggaacagtggagtgtagctggtatcagaagttctgaagtgactcagagattcagaagggtgacaggcaggggcagtttttactagaggaaagagcgatgtaggatgaacaatttactgtccctgttgattcacataggatgtaagtacaagagaagtcaaggatgtccccaaatttcttgcataggcagcagatgagtgatgtcattcactaagacaggaatcaaagaaaaatgaatgacatgtcatatcacacgtagaatttgtagaagctggagatgtatagcttgtttaaaaggggggtttagtatggagggttgaagataaaaggtcaaatatgtgaatgactaaatgtggaggaggaattagatttaccctgagtggttccaatcttgcaagttctcaggaaggaaatctgagatcaataaaatcaaactggcccacagttcaccacaccagttgaagaaaatgagctgccggcacctgtgtgagtggaggtgctcctcagttaacacttggtgagtgcaaagaatgcagagggcatttgagcaccgggtagggatggaaaggtgacttttagggtctttgttatcattattattctatgggcattcttcatatataatatttagagcttcgattctgggccacaagttgatctgctattcctgaactactacaaatttgagcataagaatcttggcagaataaattatcccaggactcatgattgctgggttctagcaatggatatgcattaatcaggcaaattattcaatcaatcttgggccttagttttctcaactgtaaaaggcagtatttaaactgttaagcacttttaactcagcaattgtaggattctaaaaagaatgtatgtacttctacgttatgatgaaagtcactcttttaagtttaaagaaaaagttcctacaaattagggtcaatttatattccaagagttctggctgtccctatcaggcccctcctccccctccttgtccttatattttcacatctgttagaagaacagatcttaatggtcctattctcgttctgttactgtttgggatctgaatgtattctgagtgttttctgtcttccaacagctggagagatcaaagaactgttcctaaaagcaaggacaagctacagccaactgcatatgtaaactttcatactgatgtatttagcacagtgaattatacccccataatttataatatgagaaggtaggtctaatccaataataataaagacctttaggagaaaacaacaaaaaacaccattccagcttccagccagtggtctgaatactcacagcctaatacaacacaaagacattccaatacaatgaaataatttggatcatgtccagcctctattttttaggatgatagaaataagctcaagagagctaagtctatttattattcagaagaaatgaaagtcatagcatacacttctaagccaagagatcattgacaaaatttgctaatgaaatcaattcataactttctttcagattttcatttaaacggctgggttcctaatatatttcaaaatttacactgattaccctctacaaaaagtatgtcataagagaaaacaatgattacagagtagcaagggacttactttcacaggaacggtgctttatgttgctgaaggcaattacaaaaagagagtaagaaaaattaaaagcaagagctagagctcagaaaaacttgggttcaaatcccaactctgttactcactagcaatttagtggggcagcttacctagccttgtagaatgccagtttcccttttgtaaaagtgtactaaaaggtactcgcctcctaaatttattttgaggataaaatgattaatataaaaaccctattacagtaccatgaaaatagtgaagccttaatgaatgttagctgataataatagtgctgtcaacacatgagaagaattagaatctggtgggagatgaagacctactccatgttctctgttctgtcttcttgccctgaggggtgtgttcatcaatatttaaggaactagaaggtgtgcatcttggatgttaaaaacaggggctcccctcacctatcagtgaacagccccaataccagagatgattctatacaaattttaactggaacatctaagataaccctgagaaatatcccaggcatatcttaagcagcctgttatttgagggaacacagaattaacccttggttttatccttagaaaaatgggatgataacatcttttttcacaattatcttcacaaattattataaaatagttatggcagagcaaaaactattgacatgggtatttgctaccctttcccctcctctcttcagataaagagaatgctggttttgcctcttctgtcacaaccccctcacctgccccccgatgaggattcaactattgctagatggattctttgagttttcatgatgcacaatcaaaagacaggggataggtagaagatatgggcttgagctcggcagggagaggggggcggtttaccagcgggagtgttggggagattttggaagagacgttagaaacatcaaagtagatgggaaagaaaatagggattgctagaagtactgctacagattatatatcccctttaccatgctttgacagttaaagaacagaagttgttaggtcactttaaattcacctttggttgactgcctgtttctttgacagaatccctacttggagactggaccaaagaggctatgtcttccatagaggcaacatgagaaagtaagagaggtgcaaacacatcatgcaaacgttaggcagaatttattgtgttcatacatgacatggggaacattgaaaggattgatgtcttagaaaggcgtgttaggagtgtgggtctagaatgcataaggttagagatatgcctgcactgggccatcatcttattttaatatttggtccaaattctgggcttctcacaatcagagagctatacctaccaatttcctcttattattcttggctgcccggtccccatccctctactcagagatttctcaagctttgcactaatggcattttgggttgaataactgttgtgggggtttggcttgtgcactggaggatatttagcaacatccttggcttctacccactagctgccagtagcatcttcatccccactgctggcaagttcagggggggtgtgggtgggggaagtcttctccaaacattgccaaatattccctggggagcaaaactgcttctggtggagaacctctgctttaccccaatcatccaggcttacaagaaaaattcatactccatcaagccattctacaacacttcattttcagagtttccaactacagagattccaagttctcagcaattcataaccattacagtttgcctcatgttacactgactgcatcaggctgtcatttagaaattataataatggctaccacttgttggatattttttatgtgctaggcattgtgctagggacttaacagggtgattttcattcttatacagaagtaagtgtggccgggcacgttggctcgtgcctgtaatcccagcactttgggaggccgaggtgggcggaacacctgatgtcgggagtttgagaccagcctgaccaacatggagaaaacccgtctctactaaaaatacaaaaaattagctgggtgtggtggcgcatgcctgtaatcccagctactcaggaggctgaggcaggagaaatcacttgaacctgggaagcggaggttgcggtgagccaagattgcacaattgcgctccagcctgggcaacaaaaatgaaactccgtttcaaaaaaaaaaaagaagtggtagatattattatctccattcagagatgagtaaaatgaggccctgaaaaattaaaataactcatccaaggtcacagccaataagtggctgaactggggtttgaacctaatctgtcccaggtccatagtctctccttgtctcaggccacactgtttctcctgatgagaaaaactaatgcagggatacacaagaaatacatttacccaaagttacatgagttcaaatggcaattccactgtatggactattgtagaggttgttgatctcagcactatgtggactcagcagtatggatgtctttgttctagggacatcaacaagctgatttttgaattatgaattttctgcagaaaataggaaaatggtgctctcctttaagtagaaacaacaaacagtagctggttgccatggtagcagaggtaaacttaaccttgactgggaaggcaatcaccagaaagggacagcaagtatggtcaggagtctaaaccagaccaggggtattttaactggagaagagaaagtcaaaggagagaaatgatagtcatctttagttatttgaaaggctactgtgtaactgaagtgaagcatacattcaagattattctaaatggaaaatccagcattcatgagtggaaattacaatgcagtcatggaagccagttttccactgaatgataagaaagaacatttaaccatcgtaatgttccaactggattgaaaaactaaacaagctgtctagagagcaataggtcgctaaaatagaaagatcctaacaggaaggtcatctctcttgggagacccagtgtgggtgagactgggctaaacaaattctcaggccccctccccaagcaaaatctctgtttctccagagaattagtaaattggggttccctgttgaaaacagacaaatggaaggtccactgggcggaaagccccagccgctcatcactacaagaggagaggtaaactacaatctcacctgggaagaaaatgttgtttaggtgacacaaaccaaggggaggagaaaccttgtggaggatttttcccctctgttctgaatagatgatcaaggggtaaggcagtaagggcaaaaccaaaaacaaaacaaacagaaaaaaacccaccaagaatcaagcagctttctgctgtcttccaaccctcagacactctgatgcctctttcttggaatgtaccgccacctcccactgctttggcctaaagactgcatttaattttaaaaagaaaataggcaaccatccagctaggggacagttagagtaacagttgattagtccttttctaaacactgtcttttgtttcattgctctttatttgctgtacaccaacaattcattaaaaacatctcaccactagatttagtgaatggagaggacaggtctaaacccaaacattcctcttggaaaaccgactacattgtaaatttgcagacctgtccaggaaagtaaaactgttacaaagtcaacctctactgaggcacacagcctcctttgtaaaagaaaaaaaaaaaaaagaggtgctaaaaaaatgacaggtttttcttaaaaaacaacaggtttttcttaaaaaacaacaaaatcttattcatctttccatattcagcatgaagaacacctaagagaattttccctatcgcctcatctccagggcactcaaagcatttacaatctcattattttatacaacacccattaagtgggcaccaaagattattacccttctttgatttctaagaaagcaactacagaaagtttaaacaagttgcccaaggtcgttcagtaaattgagatgcttggattttccattcagtgattgttctagggacatagtgcaaagtgactgaatcctctaaactcaccaaaacccctaagtcttacagatctcttccccatttctcaccactcatgagattttcatcatctaatcacaaatctgccaccatgtggatcttggacatgggtatcctaccaggccagtgccatgtctgcaagaagcctggtgctacacctgacagctttcaaatcaccatcaaatgattcctttatctagtgaagttgattctgcctggctgcatctgggaaatttttaacccctcgattagccattgcacagttggcttaacttggatgagacagaggacaaaatagtggtggtttaaaaaaatacctcccccattctgattacaaaggaggcatgattaacgaagtaccctttgtatccgagctccattctaagagaaagagaaagagctttccttcccccttttttgatcgctgagtcttttcctacttgtctcatcacccacacaatctgttcacagcccaaacagacaatccagccagtctgtggagagttcctaaaacatttatgttgtgaaagcagacaggatgaacaggacctcatctcgacaaaggatgatgggacattcagcaaaagagttcacgaagggaaatacagatggagtcccagagctgaatgaatttgcccacaatgtctaacacaatgccagcccttatgggtacttgtaaaccttctggtcaattcacagccacctccaggttttatcccccaaattccattacttttagaacaaagggttttaaaagaaaatacaattaacaagttaaggaggtccaaatcagtgctttaaggatccttcaatttctctagacctttaaacataaaaatagcaagttagatgaagattttagttccaacactaccagatcgggagttgacataatgcacataaaatacttaatacattgcctggtacatactaagtactcaaataatattacctaatattttcatcttacactgctctattttattaatgatgtttttatatatgtcattgcctgtctactcagctaaatagttccaccttatctgtttttggtataatccaaaagataaatgccttcatataattatcttatttaagctttcagatctatagtaggttacagatgagacagtaaaagcaagactaggtctcatagctggcaagtggtagattcccatactgagatctcaactcactaatttaacatccagtgctttatttcaataacaccacagatgaacagattatcatctctcgtgcctctttgtattcttcagaatttagctaagcgctaagatataccttaatgatcatctaaaataaatttctaatgataggtaacctaacatgtctgaagatttattttagtgcctttaataaggaagaaaagaaatgggtggaaaagcccaaccatacttggctttgaggaaagacatgcctctgtttttatttgccaagggaaagcattaccaggtccatttagaaagacaagaggaagtaaagccgggcgtggtggctcatgtctgtaatcccagcactttgggaggccgaggcaggtggatcacctgaggtcagaagttcaagaccagcctggtcaacatggtgaaaccccgtctctactaaatatacaaaaattagccaggcatggtggtaggcgcctgtaatcccagctactcaggaggctgaggcaggagaatcacttgaacccgggacgcagaggttgcagtgagctgagattgcgccattgctctccagactgggcaacaagagcgaaacttcattccaaaaaaaaaaaaaaaaaaaaggaaagacgaggaagcatgagggattcaatgatataccaaagagataaatggggctagagccagaactcttgatactctgctcatggctttctgtattaagttcattattaatttggcaccttgagtgagatgaatcttgccttggattatgcacatcaagttgtatttcagatggctgtcccatactttaaaggcccataccaaacccccatgtatcaaaaaaaaaaattatctgatctaaaaaatgcctagatcccttagcccttaacaacaaactgtcttattttatggatcttgtcttcccaaatttaagttgctggagggcaaaatccatgtgtttactccttctgtagcccatggctaacctagttcagaacttgtagcaacgtgtgctgctcattgcttcctcggcctcacagccttctagatgtcccaaagaaacctcgagtcatcataacatctactgaatttcccaaccatccccagcactactgctcggcttgggcagtcattaaagcttctcttctgccttcaggatcttcatttcagctgctgggacatcctgttgccatccatttcacacagacatccagcccagcaggaacccgtgttgcaatgagctttgcttcaaagccagcagcctggccaagttccaggaattgtcactaatgatcttcaccagcaacttggtgctcaacagtgatctctgaacacacacacacacacacacacacacaccccatttccaatactgctctagttagaggagctgcctaacagaggttggttccataacttattttattctttaattgttacagaggacttatttcatcaaaataagctaactgtccaaatacactctgcaatgcagcagtggcctccaccaacttactccttttttttttttgagatggagtctcgcactgtcacccaggctggagtgcagtgttgtgatcttggctcactgcaacctctgcctcccagtttcaagtgattctcctgcctcagcctcccaagtagctgggactacaggcaggtgaaaccacattcggctaatttttgtattttttaatagagatggggtttcaccatgttagccaggctagtctcaaactcctgacctcaggcctcccaaagtgctgggaccacaggtgtgagccaccacatctggttccaccaacttatttttaaactgaagaaggcataacaagtgtatcagtttcttttggttgtaagagacaggaaagcctgctcaaagatacttaagcaaaaactaaattagtaagatgatactgaaaaatatctagagataaagcagtcttctagtggttgttttgagaaatcagattatgtcaacagatctcacttctctacagtcattgaattccaccctgtattttattagcttcattctcaggcttcattggaaagactccaacaattccaggcttatattctgtgagttgaaattcagtaagaaaaagagaggacatctcttcctggtagcctccacacaagtctcagaattcactctaattagactaacttgaggcataaatccaccgtggctagtgcttggcttggtcacatgtccatcactggaatcagaagtgaagattctcttaaggcacatggactgagagtggggaaaaaaatgctccacaaaggagattcaggcagatcctgctgccaaaacaaataggcgaaacactaggcagccaaaaaacaccaatcatcctctccaataaatcttccttcttttcctaatctccaagaagttgtattactgggatgatccaactttgaaaatagtatattaaaagaaaggaacaaccacgcaagtcatataaaaatatatgtagccagtaggcacatgaaaagaggtttaccattactatcaatcaacgaaatgtaaattaaaagaataagatattatcagcacattgggaaacattttttaaacaaaagtaatcaccagtactggctaacatgcaaagagatagacattcccagatttggctaatgggtgatatgatgattatcactgaccatcaaaatccttaaaaatgtgcatttcattttacctaagataaattcacaaaagtgaatttactaaggaaataataaaggatgtacataagaatttaaatacaaagaagatttctccagtattgtttataatagccttaaactggaattattctaaatgtccaacaatagattgagcaatttaattttatccatactatgggttatcatactgacactaaaaataacctttcaatgcatgtttattagcatggcttaaataagtagaaaggcactatacaaaagaattaataaagtgggcaacaatagcatcattcactaactaaacccagtaaattagtttcaccctcatctcctaggcactccctggttccttctttaagatttaccctggggttctaaagacccagattccacccggggaaagagaaaaactctggacaccctcagcaggctaaaatgtgttgaataaatatgtaaagagagaatcaacaactgttcatgggaatggcttgctacacagaggagggtgaagaagatggaccacaactgtcatttacttgtcctggaagagagctcaaaaagaaatgtttggccaatacacagtgatttctatcacaagtagttcatattttttaaaactactcttttttcttgttcttcaacttgtcataatgtagcaattaatattcaaatcccgagttattccttccacaaacatagctactgccttgccaaataaaccataccacaaacagttactccccatctcagttttcataagtttaaaatgtaaatatccctgatggactggcctatcttagagtgttgttgggaagatcaaataagatgatttctactaaagtaccttcaagaaggataaaagcactatacaaatgtgaggtatcaggtgtatcagtgcattacgcagatttcacaaacacacaacagagcatgggagagttcatggcaagcctctggctcctccattaccctcatgtccttttccctgcagtcatttcagaaaaccagatgtttgtttgcaaagtttctctgcagcaaaagggcaggccctctctacattcaaattggctgaagctgtgtttctagctgttgaaacttagacaataatgggggagatgccaaaattaatccaaaaagcagacaggcacactttacagactggagccctgagatggaaaaaggcagcagcatgaacaagtagagggttaatggttttcatattatttaattcaagccgcaacaatgacagattctaaagatataaacttctgagagtgagcattctttcagaattagtatacaggggtcctattagcaatattttatatactccaaatatcttcccaaaggaaatcactgctgaaaaagacaaagttctttgttggtagggctgtgcgtttataccatggacttaaatacttttcttctacagtctcctcattttaaaaaatggcaaaaaatttcaataaaacatggatggagcaataagaagtacactgaagttcttaaatgcccttctttttaaatccccaccccaattacgtccctcccttgaggatatttacagtcctctatgacacatgctctgtaccttcttggttcaaggaaaacacacctacagcatttcaaattaactactgacccttactctcacactataaacaaacccttttcacaatctcaattgcattgtgtccacattgattaaagcttgaagcctggtgacctcatgtggtgttaacttctcccatgcaccaacagcattccgcctttctactcaattaccccctttggtgccagaggatcgctacccaatgaacacatacaatggacttctgcttcattacactaaccaacagcaggatagaaataagcagaagaggaataaacaagctaatttatcatgaggacagagcaagctttcaccagtctcgccatggaaaacttcagtggttaacgggaacatcaatagtctgggggtgatgtttatgatcttacagattatggacaaagccataacagaaccccaaactgactgaagaattctgcagattggcaggtgtgaacacacgcacacaaaacccatgccttaaaactccggggtcctacataaaacctactcagtaattattttgggaagcataaccctgggctttggataacgtgggctgacactctggtaatttgctccaactgttcagcttaactgtggggcccctcttatttatctttgacaaggtggtcaggaggaacccagcccctttgtgagaggggtctggttcccccaccgccccctgcttcattaggcatggcaaggacacagcggttgattaaattaacaactttggagggcttcagtcccagttcccagacattagcaccatcatccagaacaaattaaaagtctcacagcaattaagcagattttgaaaatgaatttcccatggttcaatggctcaaccacaatcttgagttaagtatcagagaagagtattgaaggaagagaagaggaactgactgctgaaattccaaagtaaacatacaactggtagaagcagcatacacaataaacttctgagcctctgctaagtaggcttatacatttcttttatagaaaattggaaatattcagtcacataaggggaaagaataaaacattaacatagaatggttgtatcaaaatggtggatttttttttcttttttctttgtttttaattactttaacatcattttattcttgttcaaaaatataaatagatattgagaggggacaaaaatacctacttccagtcacaggcttttaaattcaaacaagaaatcgtacatccaagtctggaactggaatcatctatatttctctgaaccagtacaactaggttcacagcaggcaaagaccttttatgccagcctccaaagaaccctgggtgggtgatttacctctaagaactcatttctggatcaaaagaataagattaatgataaaatcatacctatcacattctaggtgtgtactctttgccaggcactgccgttttgaggccttgtcatacttgcttccttccctttcagtttacatatgctcctttaatccctgttcccgcctcgcacctctgcctggctctacttgcaagtcacaggcctccgttcctctttgcctgcaggcagacatttggcacagcttgtgtgcaggaacctggaggaatcctgaaggaatgtgcgaatgaattcattcccactcaccagatctataagctgaagacagtggaatgcagaggtagttacttgaatgaactatattttcctgtcaagggcatttataaaagctgacatcataaatacattattggtctctaagtacaactgtaaataaatctacaaaattcttagaaggataactttcaaagatttgtttttcatctttaaaagtttatagaaaattaagcaaactatgtggctcttctaaaagaagccccttcaaaatagccctcacggaacagaagaaacacatttacttcttaaagacagtaaatctcaaaatttgcattacagttcaacagttccatttggatattcaaaatttggaaatatatatacttctgtgtgttcccttcttcccactaaactttaatcaactagtatagacaaccagccacagtcaattatctggctttatggccaagtagggaccaaaatatataacccagacataataacaatcagcataacagtaggcataggtaatgaaactctccgctagtggtcagaaagctcagttcaaaccttatttctcactatgtcttccttggaccttagtttccacaatataatggaaaaacgtccctttccaactccaaaattgtaccattttagaaatgtaagcatgtatattatgaaggtaacacaatcttttatgttcaagtgaataataaaaaccctcctcccatttaaataataatagcctggaatataatgttataaaacttagggaggacctcaaagccttaaagtagaagcattttagttacctccacaataggtccaaaatgcaaggcattcatctattcacctcttcaacagatattattgggtacctacattgcattgatctgtagtaacagccataaaggtgagtatattagaccatcattattctcatacagcttacagtttgacagaggttatattttaatcattattttttgtttaaaatttcttataaactataattctagctaatgtttcagaagtaattaatattttatttttaaaaatcatttttcctcaaagtttgactttaagaagtctttgtcattcacgttattatctagaagcaaaaaaatttcccagtggatgatgactccaattttataatgtaaaacagaagtacaactgggattcacttcgcagcaagcaaagagggaataaatctcttccacataatgagtgatatccatttaaaaaagtcatgctacctgggcttatctatgctctaaagagccatgaatactggcccagaattttaaaagacaaacatttagattcaaattaaatgttggttaaaaagaggaaaaacaacccaagttaattactctaatttaccgaatatatgaatgacctgcttattggactattggctagcatagatcttgcctaataggaaggctatcaagcagggtggctgggtttctaattttatccaatcaattaagaggcagaaataacctgcccattgaccttacgagacacaagttgactccagaataaacaaacaaacagacttgaaaagttaattatgggcaacctctccttcagagaaatggctcacatatattaattgatctaacacctatgtgcaggctcccaagaagatggaactcgttctctcatttaaatcccacaacccccgtgactcagagatttttggttcaggaaactgaggctcacagaatttaaatggttagtctaggttacaaagcaagtttgataacaaagagataaatcagatcactgccatttatcaaccataaaaccacattccatcagttattatagaaatccatcactttgaatggagagatcaagtttctcaaggattaagcttctcatttaacatgaactatcaaatggaaaacctcgagccaacacttatttttatagcgtgactatttctcaagaatcctgtaagaagcccacatcaagaggcaactttcaaaattactaaaatttcaaaaatttcaaaattacaaaagtaacagttctgtcaagtgggaagagttaatgcctttcctttacagagctgctttatgtaactagccgaagttttaacatagaaatattactgtttcatatatacattaatcttgactttgttaaaatcccaaacatactgctcatcgatctcctaaactttctctttttcaagaagtaggtgggggagggaaggaaggtattggaggaattcttctgatatctgtaaaaacagaaacaaatgctaattaaaagatgaccttagtgccctttcagtttaaaaatcttgagcatttacaaattatcttttttttctctttcatcaactattacccagaaataccacattctcatagagcaaagctctgtcctgtttgggcatgttcaaagaatagtgccagggatttaatactggcatgctcatggacctgcaaattctgaaattcagggggaggcatgaataaaaagatagctgaggtcccacagttgcctgtcacagccaagccccaccccacccacatcctcatatgatcctcaagaagcaaaacctttctgagatattctataagtgacagcaaggcccaatgtgcagtcttttcaaagcctcagtaaaaatcttatctatgacttcacttagcccagacacacaggagctaaaaggtaaaagcctggttcacacaagccagaactagctcaacagaaccgaaaaaagaaaggaatgtcttttctatatcttttccatgtctgaggcattctgctctggggcaaattacaacctaaataagaacagataaaatatatgggaactgagtaaaagaaatagaacctcaaaaagggctgctctgcctggaaagaaggctggaattcataaaacatggaacgtaacttttttagtgatcacctgaaggcaagcttgttaaacagagacttaaaagtcaagatttatttcagctaaattagatggtgcagaaaaacatagtgcttcgtgactctgctcagtttcaacaaaatgaaaagacagaggaggaagaatttacagtataatacttgcaccactcaaatcacaaaaatacacttgttagtcacaaaggaggggcccataacattgtaagccttattttggcaatgtgaattttctgcttgcaattaccttcaaagtgaagaaatggcagagacgaagaatgaggaattttgttgctgcttttgtatgtaaattcgaccaaaatatatagtgctatgtgactttaccccaagctcactagaacttcggaattatgcctgccacaaacatcctccgaaagcacaagaattagtcatagatttttttagtcaaggaagcctcagactgataaagtcttaaaactagacgcaaggactgtgctttggattggataagtaatgactatactgcgtggttttggtgtgtgttttttagagttttaaatttacatttccccaagcaggaggaagggaatgtaccacaccctcagcaagcaaggaaggaatttagttgattttttttaaattctgtagtgttccttaaaatccacatagcatagcataacattctatataattctgttgttccataagggattggctaagtatattaaggatacaaagggaagggggagatgacaaagttattgctattttattttcaagtgacagaaaaatcaatcgagctataagaagcaccagttgggaatgttctgcacattaactctttaatagccttagacagaaatcagatgatcttcacactgaaactctgaaggacatatatctttggggcactgagtagcattagaaactgcgtccaagccatggctccacctctaattgcatgaactgaatggcttccctttcctgggactcgaattccttctaaattaaggtagaacaagatagtcttgaaggccctttcatccttacgatttaatactgacaagctcttcagcttctattcaggacaaacaccaccaaagtgtatggatacaatggattcaagtagccacactcatggacagtgacaaaatcccacagctttagggtggaatcaagtatcatattggcctagaatgtattgatgctgccaaggtgtggggtgggggtgggggtgggggtggggggcaggggtgaggtaccactgatgtgtgaaatgacttgcctaatatcccagagacccctgaatcccaggcattcttattctgaatagagacttttaatcaatttcttgtctcatcctatgtcctcatgttaccatacttctacaagtctgtgctgccagtgagggttggcaaatcatcccaactcagaaggacagacttacaaaatggcataatcaagcttcactaacactgtatataaagtaaaagtaatagattgagtaaaagcatgagagattctcttgggagtaaaatgtgcatgctttaggagaagatttggacttgtgttcttatttgttagttttctgcaataacattaatatttatcatttgggggaggttcataatgaaatacttggttatagcacaggaactaatgttagaaagcaggatgacctccttaaactttcaaacccaaaccaagtaaggttttgggtcattcccattccttctgcctcaacagatctacaaatctgtaggtgttgggcaaagtggtggtgactcaaagaaggaaaagaatggataataaacagtgtcgtgtgtaagtttccccagatctaagaacagagagggacaaagaaatgtaggagagatggatttgggattaatcaaatggtttcagtgcaaagtcctctggaaatcacatctctgataggcctggctcaatgagacactccaacaagtgtcaagtcctcaagatagtagattccagtgatattttatgcttgtagcaatccccatgaggaaggagggctctgtttcacatcgcagttgagagagggagtcaatgagattttatgacttttttgggatcattgaggccacaggttgtctgcagagtcctagccaagtttctctccactaaatgacgctgctttgagaccagaagctctctcttttggagggggtcagccaggaccaaggcagcagttaactggcctccaaccaactttcatgaggctggccttattaaactaggtctgaagaaaaactgagtcaaccatttacagacttattatcttctttctaaaggaaaatcataatgccttgccaaaacaaatgtaataacttggccttttctttcaattacctctgctttcttggaaatgtgtatctgtggataaaacctctgagttaacccagggaattaaccagatgtttaagaagaccctgtgattcctgtgggccagcaaagaaagaataccccttggccacattatgagaatggagtactaaggagaaagggggagcagaaaattaaacttgaaggcccaggatttaaataggcatagcagatagaaatgttagctcagttttgggggattgggtgacactggaagcaggttttggaaatccaggcacaagctgtgtccttgaaaagacagtctcatatatttccagagcccttcatttcattttcttcagtctatattctacccccatcttcctattccacatcctcattacactcccatttcttcaacagctaccttcaggacctacgatgtatgctaaatccagggaacattcagagggcccactatctcgacaaatttcctattacaactctaagccatcttttgctgtatgcaataatttcctttggggagtgttggcatgtaatttctgaggttcagccctccctagcatggcccagaaacactgccaatatttacaatggctggtgtaggcagttcttatgtctcaggagttggggatcccttgttaaggaagtaataggccaatgatcagtaaccatgcagtgatatgagtgcatggtttggggaaggggtggaagcaaaacgaaaaggtgggggggattgagctttcatcttctgctctatctgtgtagaatcagtttcaccacactcatccctttgtttcccatagaaatggaaaggacaatgggaggaaggtagcattaagcttaagaatatggcttaggattcaatcaaggactgtgggcttgagtcttagccctctcatttactatctctgcactcttatttactatctctgcaacctcaaaaaaggttcttaaatgagcctcagattcatgtgaaaattgaagaaagtaaagtatttacttctttgggttgatgtgatcattaagtgaatctttacatgtgaaacgctttccatagtcccccagtcttccaatatgattactgcttttgctcccctacaagatttagtcagggatagaatgtggggggtggggggaagaggtggtagtaagaggctatagaaatttagtatttttatattataaattatacatcattattttctttaatttagcaatccttttagattcatcattttatgagaagaaaacttagaaaacactaaagtttgagatcattaagtttgagaattggcatgtctcaagctcctcctctccttcccacatccccatacgggcactttctctagaactgtgcagagctggcacatttattaggccaccatcacaacccttcagagaaaaagtaagacctaaatgaaatagtcgtgatcatttcgtgtcttgatgctccctgtgtctcattacctctcagggtctctatcaaaatcaagggctgcaaatctttcaatagagaaatctattagcatattttccaaagaacaaaatgtacctattcctgctgtcagggctgctgtttgtaggagtctctggtttaaaaggccctcgttattatgcatgggtgtgcatacaaacaaaacttctccgcatgggaaaagaattttcagctttcagtaagaggctcttttctcaattcctccaccatcactaccaacctacaccctctaaaaacctctccaacctccactgattctttctttcctctcctttgaaaaagtccggacttactgtataactacatatatgttaaaatcaccaactagagaaaataaaattgagtaatattcttgcaagtagcagaatctcaaacatttgatggttaacttggctgctttagtcaattggatgattcatacaattatggggactggttagaacttgaatggaattggttggactggcacaggcaaacttctcaagacatgtcctcccctcagccttggcaaggcactttttgggtctgtacagctggactccatttcatttatcatcacatttaatattttcttccttttgatgttacctgattataaaaatgagaaatcagttttagtgctattctcatgtttccctgcattcagatttttattcaggcctaaaagtcaaggttttggggaaagtgggaggatcacctaaagttgataatctaggctctgatgtccgattgactggagttcaatcccagctttgaccacgagtagctaggtaatcttgtgcagttttactagatctttctgcacctcagttcccttacatgtaaaaggggtacaaaaataccaatttgccaaggttttgtacagatgaaattagacaggctttggcacatattgcacattcaatacatgttaaacattttatcattttattaatatatctatttcaagatgaaatattaatataattagttgatggtataattagtaggggttctaatttcatacattctcgaattcccaataaataagtgaaaattatcttgatgctagaaaactacatcctaggaaatcttttgttgtaaacttagatgacgaggggctcttttctacccacagctcccctagtttactcaagctccatgtctcctctttaccaaccccgtgtcggcatgtagccccatcctgagcacacagtacaccctaatagatattttgcaaatcaggcaagtagcacacaggagttttaaggacctttatataatttcaacaaattcaaaattctaaatctccatagaaacacctttatgaggaatataaggtaagaaatatttctgcagtttatatggatttaaacattttaaggtcaaatcattgtaaaatgtcatgtaggaagggaaggcctgaagtctcaatctgggtttcaggcagggaacctgaaaacctcacaaagccacacataacactattagctcaaggaaatgtttctcactgtaacaggaaaagggaaagttcgaatagaagtctagacaggttgtactgaaagaacaatcagatgaaagagcaattcaagccgggcatcttgtgcctgtaatcccagcactttgggaggccgaggcaggtggatctcctgaggccaggagtttgagaccagcccggccaacccggtgaaaccccgcctggccaacctggtgaaaccccgtctctactaaaaatacaacaattagctgggcgtggtagcaggtgcctgtaatcccagctatcgggaggctgaggcaggagaatcacttgaacccgggaggcggaggttgcagtgagccattgcacttcagcctggctgacagaacgagactccgtcacaaaaaaaaaaaaaaaaaaaagagcaattagagattgttagcatgagcatgattacactgcaagaaccaaatagttaagttttttttaagtcaaatattgtaatttcaattactcttttaaaaaagagtaattgaaaactctttttaagagtttacaaaagagtaaattaaaaacatgctcttttaaaaaagattaatttataaggttgcacagtactcctacaaaccacattagatacttctagtagttaacaaagaggaaaacaatgacattttacaaaataaaaagcagaattgaatacagaaaaatatgacttaacatcaaccaaaaaccaattgattaatcttgtcaagattcttgtcaagattctcaccagacacccaaatactgaaggattacaactattgcatcattaagatatattaaaagaaatgcaacaagcttaaaatctaataaattggagagtaaacacatatactctgcataactgtaatttaatttcttaaaattctgcaacttccaaataaacaacagcagcagaaacaaaagctcacataaatgggtcacagtaaagaccagttgcctccacttaaacaatactagcacaatcgtgtgggctacatccttgaaagaagtagataatccatgcacaatttgagaaaattgattacatatgtgtgtatgttatatcttatacagtatacattacatcctcaacattaaaaatttaaaaaggccactcacataagttaccttttggaagaaacaatgatcttttctaaagaaataataattggtgatttgttgatacttacagtttatgtttggaatagtctcatttatgggtatgctgaaaacaatgcaacaattttctattaatccagttctgatcttcatactcttagcagttttagaagagctgagaacagtgacctgctttttcaaccattatatttctgagacatgactaatttgaagctgagcaaattgcacataatgggattcaagttcatgatttttagtctgcactctcttttcagggtacatggtctccttccctccctgcttctaccaccacccccaaagctgccttttcaggagctaaattcacccaacatgaaatcaaaagagaattatttttaagttttctgcaggcttatttttaaggaggataaagttatatttttaaaaatatttatcttttccttcaggtactaccgcatttttaaataatttctaaatatttagaatgtatttagatgtatttagaatagtagatgtatcagatgtatggtttcatagtggctcaaagtttttaaaaaagcattatataaatcagtgaatttataaataccctaagttctactatgtaagatgttgctttcagagcctttttgcaaaatcccattaaaggtttagcttacagacactggtgccaaaaaaaaaaaaaaaaaaaaaaaaaaaagcaagcaaaaaaatgtgtttttttttgtttttttttttttttggtaagaaggatgttgaaataggagaatatttaagctggctaaaccaaagccaattcctggaggctagttgcttttatagtgaatgtttaaattttctccatcaaatctagaaggctacaacgaaacaacagcctaaatgtcatgtacaattctctaagtactgaaagagttacacaattttagaaccgaaagggaccttaaactccttcctctaccaatgaggagcctgaagcctgctagttaactcacttgcctggtcactctggggttcacggattgttattgtttggtggggtggttgtttttgtgctgtatatttgtgtgtgtggtgtatgcagtactcacacccttacaaacaagagctttgccatttatattctccccttcctaagttgctcttcctaagtttactttcatcagcaaaaagagtgatcaaaaagaaaaatatattctggccagttcaaaggggacatttctttttctcacttggcctactgcagatatattagagagacacttcacacccaggacaactgactttttaagtggcaataacaatgagcagcggaggagttctcttctcactcgagagagcagaggaggtttctgaactttaccttgacttccagcctacaaactgttccttcaactactgtctccgcttgcccactttgttgctattctttccttagtttcctttgttttccagcttagggaagtttggtgggaaaatttttcacttacattttgttgatatttatttcccatatttgggtcctacccaaattttagatttaagagcaaaaaaaaattactgtttaagtgaaagaggaaaggctaagtcactgttcaacatgggctagatctgatctgaattggagacacagcctttgcaattgaggaaggagaggtaagcagtaaacttatacagtttcctccaagaagtgttatacatagatatttttcaaggaaattggaataaagcagtttattaattgaggggaagctagttacagttagcacctgccgcggactttttgaggttgtcgtcattaaccaaattcttcgggaaaaacaatctttggcaccacttactccagacaaaccctgtttggaacagacaagtgttctgaccctatagtcgctccaatgtccaccagccactcacgagtgcccttagggcttctccttggtggtagcatcccagaaatcctactagtttcagaagtgccctaggaagcctacttcttggataatgggctctgtctgcaaagctaggagatcagcctagaaaaagaaacacaccaacaaacaccaggaaactatgtgtaatggtttgctgcttgtgcaaaaacctcaaagaggatgaaggtcagacagggataataggccaatttaattctgaaagcacaaggtgcaagaaattttaattatggtctgccactgaaatcacacaagatccaatggcatctaactgcaactgctcatcaagggagacaagaggtgtaattgtaaccgctgcataatcactgtgagggcacagggaaggctgccttcagctcccagcagagaaggtattaagagcctcgaaaaatccaatacggggaaacgagattgcatgtagccaaacagaagctcctaacacaaaagccaacccgtgtgtgtgtgtgcgcgcgtgtgtgtgtgtgtgtgtgtgtgtgttgagggtgagggttccagaaagaaaatgtgaagctgtttggcccacactggggataagagattgtttgaaaactctgaacccttttctgttttgtggataaatgcacacagagaaaagagcactgtctcctttaggtatttctctccttgatgaagcttcacccactctcctttgtttaagacaattggcttggatgttaccgtgatttacagtaccaaactccctttaatttgttcccatcaaacccaagtctggagacaaaacgccaagcacacgactggaggtgcccaagcctgtgcagctctggcagcgacgccgccggcgcccccgggcgttttccccgcaccccacatcgcgtgggcgcccgtaaaggcacgcgcggagaaagcccctccgtggactccccactccgcaaagtttaacaaagccgtgaagtaaggaaaccgaacctcccgtccgcgcccgctgcaaagttggcattgaagtttgtgccgggatgtcccaaatcttgagggggcggggggcgcgagtgtgcagagaggcgggaggatggatgcagatggggagacagtgaggggaagggagtttttccgagtggacggtccgtgaggcggttttcttcacccggaagcctgtttgactcagagaggtccgggaggtgcacgccaggggaggtctcccggggcgggcgctgtcgccgaggaggccggcgagctgtcacctgcggggggctgtggtgggagctgagggcgctctcctaagcgccaaaagaggacggggacattcacagtcaccggctctcggggctctaagtagtgggggaagggatattcacgagtgggcaggaggccaaaagcaacacctttcggatacgcttttcccctccgacctctccaacttcccgcggcgctggtcaaggactccctcccaccccaccccatcccacccaacctcccggccgacaattcggacctgtccacggcagagcgtggggtggagtgcggcgggaaagcagagggcgcgaaggtcgggaccccaaattgcaaaccctcagcccctagcaaagacgaccaaatgcatttacaaccgtgcaagtatctcagccttgtaacagagctccgggtttgcgccgggcacagttccccgactcttctgttgttcctaataaagtcgattacgttgccctcccggagctgattggaagggaaccgagaggaaaagggggggaacgcgggaaaaagcgggggggggggggggcgagcaatcaactttgtaacccagcgcttcctcgcgcgatccgtcgccatgcttaagattcccacccccgccgcccccctcttgcctttcaagtggatactgaaactaggccaaaactttttcccctccttttctcttagccactagactggattgtgccccacggagccccatggagctctgctttcttaagcacaatagccggactaattagatcatagaagcaaggcagtgatactgtaacaagtagcccaagaggcaaagagggaaggggcccgaaaagacagaaagggggaaaagtttgcagctctccgcacttaccaatcaagcctcccaccagaaaggcgatgatttggaacacgagcagaatcccaccaacaatgcacagcttcttggtgctcatgttttctataattgccccagccatttttgcgccccccctttttcttttctccttgaaataaatgttttagggtgagctttttgctccctcctctcacacactccctccttcctcgcctcctttctgggcgctgcaaaacttcagaggtgctggagcgcggcgaggatgggaccgggacggaaggcgcccgcacggattcccccggcgcagccggctcgggttcccccaatgcccggagctgtgattgtggccgctccgccgcctgtggacg

SEQ ID NO: 1080 - DNA, 107189 bp, Homo sapiens
tatgagttttagcaggaggggatatgcatgtacacatatgcatatacatacaggtttatttaaatgattggatctacacttttggaggctatttgaagtatcttatcaaaataaaacgcattttaagcaagaagttaaaaaagcttttcagacccgaaggccatttaatacagtaaatcttacttgggtagtttagcaaacattttttaaaacccacatccaacagattggttagtattagatacacagatttggtttcaaagctgaaatacccctggtggaataaatcttctcatgaaattcagttatattatgccacaaaacagggacacttatctattgacaacttaaatattaactcagtgggctacctggtgatataaataggaaaaaaacagtggtcatggattaggagtgagaagactatgacaccagcctaccttggactgggaccgcaaaggatgttaaaatctatcctagaatttaaaacaggaaaaatgtcaaatattccactccccattcggcccaaaccatcccccaaggaatacacccccaccccacccccacatgaggtttactaaccagctgctacagatgttactatgtcactaattaacaatgatcacagaaaatgtgtcataccagagtttttgttatcatacacaatgcattagtggctgcaggaatcttcctccaaaagctaccgtcagaaggcaaactgacaaatgtccatgccgctggtccaagaaaccacagctaagagccatgaggcattcatttgtacattgagctctctctggcatgctccccactctagttagaggggctggggtatggagagaccgtcccagccgggcgctgcagcctcctactcctgggcctccttgcgggtcaacttgtagatctcagtgggtccgtccacatgggtgatagtggtggtgagctggagttcttccccactatggacacccagatcgcctgaaacagggttttcggtgttagatgcattcaaggaggaaggagaagcaagctggggttcatctcatggacaactgccctgatgctagccctctttgacattctgagcacacagagacacctagggcacacaacattcagaacaaggactaactccaaacctgttcacttggactttgcagaactttttaaaataccatttttggctcctagatgacagtcattaagatacgtgagtcagctcactgctgatattattcatagtaatcattaacatttaatgagcatttactttgtgcctgacgctattctaatcactttgtaagtgatcttctttaatcctcgcagaagccctctgaagtaggcagtatgaacgtgccagccttacagatgaggaagctgggaggtaggcaaggtaattgtcctgggtggaggagcaggcccacaagagagctggcaaaggaacatctgatgccaagaccaatgtgatgggctaaaccagcataacacccctcccaacggatgggtcagtcaggcaccaacacatttgctatgaataatttacaaaataggagccaggtgcagtggctcaggcctgcaatctcagctactcgagaagcaggggtaggaggactgcttgtggccaggagtttaagatcagccttggcaacagagcgagaccctgactctaaaaaaaaaatttgttttaattacctgcgtgcagtaactcacacttgtaacctcagctactcaggaggctgaggcaggaggatcactggagcacaggaattctaggctgcagtgagctatgattgcaccactcactccagcctgggtgacagagtaagactttgactctaaaaaaataaaaaaataaactacaaagcatctatgtcacgtgaaagcaaataagacctgcttatatctatccatagattggggaaggagccatgtctaacacatctaggaacaatgaggggctttattctccaggaaaaaagaagtgccagaaacgtgctgtgcatttccttctgccctcaggattgtcctaagtgttctgaactcattatcagtggacagtgttctgctaaaatggaataatttgaacttttctaaattagtaggagaaaaaaattttctctaagttaaacctcgaaaactctgctacctgccataagacaagtgaatgtataaacaacaaagggaaaatggaaaacgcaaccacgctcagtctgactgtgtgtgggggtgcacgtgtgcacacatgtttgtggagaggggtgctggggaatagaaagttaaacttgtgtcagtgatttttatattgtgcacatatcatatgataagttttctggaactgaagtttttctaatttaaagcatagaattaagtaactaaatgctgttttccattgaaatgccataccataacttagaagcagccttggccctacccttaggactagtaatcttatcactaatttaagaactgctaggcatcaatgaatctggtggccttagaaccccagatgtcactcccacccactggcccagcaggctgcttggctggttcccttcacgtgtgccacgcagtattagtttctcatcgtagacccatttctctgtggctgcacagcaaaatcagtcctattattaaatgccaccctgtaagctctctacccaggagattccctggcctcagaagcagactcattggctgctgcagaggactgctgaagacatttggggctgttttggcaagggtctaatccacaggactatgggtagagaaggcattaaaggggcatcagtccagcctccagcacatccacattcatctgccctcaagccagagcatagatgccaagtaaggctggtgagaggctttagctgggctactttgggccaagctgaaccaccacttgtacagtgagcaactactcccaggccaataacttgtattctcactgctgcaacatctagtccacacctcagtcaagcacaagcagtctaagcttcacatttctcagtcaaagctatttctggatttgcatatctgggctagccatcagaacttcaaagccagtttcatgatctgcatgtctgtgtgagtcatcaaaatttcaaagagtcctgaccaccccagtggacccattagcactcataaccgtttacctaaggaatccctttccctgaggacttcttagaaatagatgctagagagtaattctactcaggctttgaaccaaagatgttaattctttaaacttaaaatatgactccaattagcagatcttagaatatgcatatgatcctacagatcacttgaaaaaacagccaaaattgccttggcttctttatttaaatggatacctatgtcataatgcttaacacgtgcctgacacagttctaaatactgtacaaatattaatgcacttaattctcatagcagtcctcagaggcactattatcatcactcccattctgccgatgaagaaactgaggcacagagaggctaagtaacttgcccaaggcccaagctgctaaatagtgtgtgggattcaaataaataggtgccaggatgcaggctctcaacttttgggttctgctgcctcttcttaaatattcaagtttccagcagccagtgagactgccagtgaggtatgaagtccacacacacagcattacagctaaaaatatccgcatacagccgggtgcggtggctcacatctgtaatcccggcactttgggaggctgacggcggcggatcacttgaggtcaggagtttgaaccagcctggtcaacatggcaaaaccctgtctctactaaaattaaaaaaattaaccgggtgtggtggcgcatgcctgtaagtcccagctactcagtaggctcaggcagaagaatggtttgaacccggaaggcggaggttgcattaagtcaagatcgtgcccttgcactccagcctgggtgagagagtgtctcaaaaactaaacaaaacaaaaaactacacataaaataatttgaataaattgtttagcatatttactttgcttttgtatctgataaatttatagcatataaatcagtgcactgacaggagagctgttataaatttatgagtattggccatatgcactgttaggggtttagcatgccctgtatttccttgtacgatgtgaagctactgtggcataattaatttctctactgtgctggatgaggacccagataatgggactccatgcaccaaaatctatgtttcacatgtgattttattgtaccttgaaggccaactgttcccccttggggaatgggtgtgtgaacgtggcagtaacatagcacgagtggagatccctccacttgcctcctaattccatcacctcctacttctgccaaggtcttgctccatctgttagtttccccctctcttggctcctgctgttcagtgcacaaacatgctcaaaagtctcttcccatctcagacaagaaaaaacccttctgaaaatgtgatatgtgtcttggggtgaaaaagagtgagaaagaaaaaagaaaagaatgctttagtttgcagtaaatttctctccctggttatgatgtcaaattcatcacagctcattaacaattagatgacggtctatttcttcctaaccttgtgaaatgagaccaatctctggcacagatttcatcccaaaggactacggcaatgcatccatatgtgtggagtcacatccacaggtgtgtaagcggctgcttggttgtaactgcctggaatgcctaatgaggatgaagaaagccatatgcactggagacagcttcttaggaccggcagcattttaatgacaattgtttgtgtatctgtgcccacttcaataaaaatgacaacagctactctcattctgaggatgtattacagattccgggagagatcggaggtaccactagaggtcttctaatattaataaggcctacgtacttccatcctcaccactaccaatgcaaattaacaccccactgcccaagtgtgaaagccagggagctcccataccatgagttcatatttgttctcaaggtcatacacaatgtgtgccggagccaagattccaaaccatctgtgtctacctccaaagcttatgttctttccagaacattcatgacctatccttttttgtagaattttccctaggcccacaccaacctctctcctattcaccttcaaagctaagttcaaatgataactttttgtaacgaagtctctggttcacagcagaatgagaaaaacagaaaagtgtagtattttaaagccaaattattttcatgcaaagaactgcttaagaatatgtctgccttacatttttggtgttaatatgattgttatgttaaagaacaaaatagtgtcgctggtgcagtggcttacatctgtaatcccagcactttgggagacagaggcaggaggaccacttgagcccaggagctggagaccagcctgggcaacatagaaagatcttaaccaaaagaaaaaataataataaaatggtgaatggtaggtttcttcttctttttttttttttttttttttttagatggagtcttgctctgtcacccaggctggagtggagtggagcgatctcagcactgcaacctccgcctccagggttcaaagagattctcctgcctcagtttcctgagcagctgggactacaggcgcatgccaccatgcccagctaattttgtgtgtgtgtgtgtgtgtgtgtgtttttaagtagagacagggtttcaccgcattagccaggatggtctcgatctcctgaccttgtgatccacctgccttggactcccaaagtgctgggattacaggcgtgagccaccgcacctggccttttttttttttccaaagaaagtaaatacccaggacagtatgtggtatatagtaagtgctcaaaacacccatgaaagatttgcctggtgcaggcaagggcagttcctctgtactctgcatggctgggtctagcctagcatatcggcactggtgttcttccccactggcatttaggaaaacaccctcagttagaaaacaagtgtgccttgggatagctcagctttgaggatcccttctgggagatggggcagagtggctttggtggacagggttaagagccctgggtccagttgtctctcggtgcctgtcaaccccagaggtcatttattccaggcttggagcgagccattgcccatggacctccaaagcacctcctgacacttactgccaggcagtaactgcaagtgggagaagaacacaatagaacttattagtttgggggtaaaatcttggtgttacaggctgaattgtatctcccccaaactctcaaattcatatattgaagttctaacccctagaacctcagaatgtgactgtgtttagagatagggccttcttaaagaagtaattaagttaacaatgaggtcaattggggatgggccctactccaacagactggtgtcctttgaaagaaaaggagattagaatatagatatacacaaagggaagaccacgtgaagacacagggagaaagtatccatctacaagccagacagagaggtctcggaagaaacccacgttggtgataccttaatatcagactgtgagaaaacaagcttctgttgtttaggacaccctgtctgtagtattcgtatagcaactctagcaaacatttaggaagccgaaggttcttcccaagaaggtaactgagatgtccctatcatggtggggtgacaagaattctaagactcagaaaaaatgattttaattgactgggccaggaaaggtcaggtcactggcacagcaatagccctgggagaggcagggggcagaagacacctgattacaaacagctgagcaaggggtgccaggctggtgacggtccatcagttggttcccaccttcactggggaatgggaaaacgcttttaagacctgctttagggtctgggtccagcccgtgtgacaagaccaatcccatcagtgctcacagacatcaagaagctcagctggccatgggcagatcatctaatgtacaatcagggagatggcgtcaataaaagggggcaaccaatgtcagggcctcaggacttaatccaacgctttaccgaggcaacaaagccaaagccatctttcctatgaaacaaggggcaggagacctcagaaacctccaggagtaaaactgacatcacactgtagctagctgccaagacgcggaaccagtgttgccgcttttgctccccgcagagtgggtgcattagacagaaaatgcttagcgtgaacagaaataggagggaatggtggcagtgagggcatcttgtgttccctctgccacagtcatctagttgggaattctgtgtctcacttctttttttaaaacattctgacaagaattttataatcaaaagaacacaaaaatcaaagctattatcaagaattgtctgacttcataagcagctccaacttcttattcccacctgaattgtggttgagtgggtttgcacagtttttcatgtgtgcagggctttgctgctggagccccgggaggtggtatttttgctctgagaagaggattcactttagcctgctgcaattcatatctgcctgggaagacatccagaatgattcacaaattggttatggcaacaggtaaaaagaacaactgtcatgaaaaggcagcagcagcaacagcaacagcagcagcagcagcagcagggcagaaaatataagtgttccttgaaggaaaggtaactaaaatatctttgctaaatttaaaaatctatatgtgcacgtgtgtgtgtgtacactcagacacatatgcataaaatgattacacatataattctatgtacataaaaataaaatgattaatgtgaatgagtttgcacattcactgccgctatggtccaccagccaataggaaggaacccaggggaagtccacgaaagcctgtggctataaagaatgtggcgccacactcccgcagcacctatctgctggtgagaacactccagtgtggagttgtcctgccacctttcaagaggtagatgaggaaatcttgtcccccagaccaggctaaagaccccttgagagcaaggactatgtctctgtcactccttcgagcttcacttcactccatctcattcaagatggcacaaggctaagtactaaggaactaaggtatgaggtatgagctaagtactgaggtgctccgtggttcatttgtaaagggtcactttctgatccatactatgaaagagaaacagaaatatatgagaaaatgctctttggaaagtgaccttgtcttgaacctgtggcccactttgttcttctctgtccattctatgaccaaaagagagaagaaaaagtctatcgtgaaatgctcaatgattccatttccttcctacccacttctacttcctcctgacacttggcatgtccctccaactcacataccaaacaacctccatcaaagattctttcccttttcttattgcctttggcatcagaaactgcttgtctgtgctccgtccaggatccatctaacaaaggctgaagccccacacacctgggattcactctctgtagcaagatatctgaattcctagctctgaagcttcaaagcaaaggagagaaagaaatagggagggaaaggccaaagccaacttaaagacttcccatgagaatggaaaaggagcatgggaatgctggaggtggagagagaatgccatccagagactcagagaatgtaaagacacatgtatccttccttgcaagagttcttctttgaggtttccacataatattccaaactaggtctttccaaggaacttcgaaatcttggcaaatgctccgtaattcctaggatacatcgtgtgatctggtggcagatgaagagatgaaaagtgaaacaaaatagagaagaaaaataagcagaatgcccaacatggaagagaccccttccaaatgcacaaggtcacagcaccatgcaggaaagggaagggcccacaagctgccaggggttcccgggggtgctgggaaatcacagatcatgttaccaaaggagaactgctaaatcttatgacttttgtgtttaggatcagcatatggtccccaaatagtttgcccactaaattgcctgaagaatgttttttcacagagggtctacttggcatttcacaggcaggacatttctttatgacatgagccttgttttgcctattgaacaacatttagtagcacccctagaatctggacactaaatgccaaaggcatgtcccagttatagtcacaaaccaaaacaactgtgaacatttaaaaacacccacttagcagaggattcaggggatatgacctcttgttgagaattatttgcaagttttccatgaaattacagatcaagctgtctttgatgaaaaactctgttgaggaagagtgaagtgcttttctcaattgcaacatttcaagcctaggagactggctactgtgtagggtgggaagtcctgatgggagctgcctaatatatggctcaaatctcaagaatctgtccaacatggtggtctgtagtcatcctgcctctgcagggttggccacagctctgggctcccacttgctgaacagtgttaaagttggacacgttctcaccagtgtttggaaatcccttacctatgacagatatcactctctgggctgccacttagtggcaagaagtgttcttctgccccttccctgctaataggaagaaagacaaccatggactttcttttcttttcttttcttttcttttgagacagggcctcctctatctatcacccaggttagagtacagtggtacaatcatggcttactgcagcctcaaactccttgggctcaagggatccttctgcctcagcctcctgaatatctgggactacaggtgcacaccaccatgcctggctttttttttttttttttttttttttgtagagatggggtttcactatgttgcctaggctggtctcaaacttctgggctcaagcaatcctccagccttggcctcccaaagtgctaggactataggtgtgagccattgcacccaggctaaccacagaaattcgtagttcaaaaggacttttaggagatcacttacatttgggagcagtggtgcacagagggttaagtgttttgccaacagtcacacagtaaaaacaaccaaaagaatttatgtacataaagtgctgtagcacacagtcagtacttgataattatttcccaccggtattatcattccatcatccaggaagtccagccattgctttaagtggtatttctctggaaggtagaaactctacctactcacatcaaggacaaggccacatggtttccttcagtgtcccccacaggatgaccatggaatgaaatcaagattcttgtccacaagcccagcagtgcttgctgctcgtgttgtggaagcccactgcttgacaggctgaatgctcccattttccacatgtacagtaaaaacaccgagtggtgtttttactagaaatggaaaggaagaaggctgcctagctcacaagccttctagcaaaacagtcagtcaaaccaaagttgggcagggggtaggtaagtaaatattctgtattctcacctcagaccagagatgggcttgaaactgattgtaacatgtctactccaaagaggtcaaggggtgagggaaactcatgtccagcatgctctcgcatggacatggcaaatacaggatgaagacagacagtggctgagaccactccacgtcccttgacccccagcacagatgccttcctctcctgctccacttcatctcatctctcaagtaactacccccctcccttctccccacaagatcactgaaggctaatctagaactcttacttctaagcattaattcactcaatattttaaaagtatcctaaagaactggtccttgccctgaaggagtcgatgatccagcaggagcataaaggcacagatgactcatcttccacctctacacaataaatgtcatgtggaaagtagactcatgatcccctaggcatattccttaggacaacagtttcaagagatacactgcctaaagaaagggtgccagggccaaatgatctaataattctggaaaatgctgttaccaccccccgctttgtaaagactgacagtacaaattaatgtactaaaggcattaacatgtattgcagtgaaaagccttattagtgctgatcaactcaatcattctcaagcatgtttgactacctaaatttatcaacatttcatggagacaatattccattgaatgtcatttgctggattctaattggggtgattgggaataggtgttaaagaagatgctgcattttgactgggcccaaaagatgagtagagtttcattagtcccagatggaggcagaatgtgcaatccactcatgcaacacacactcactgagtacttcctaaaggtgaggccaacccttggctctggggggctgctaccctggtttccactgcaaggcagagtgaaaggcactagagcactgatttgagaaagggcttcctatgtttggggaatagcaaatgcatggctagagtaaagcaggtgtaaaaagagacagaatgaggaataaggctgaaccaaacagaaaaagcatctattagatcagttgtttatcaggccacctgttacctgttaacagcactggcctagacagtgttaatcatttctgtctgctgtggctagtgaagaaaccctgagcaagatcttcccttctctaggcctcagtttctttatctataaaatgactggattctctaaggctacttgcagcatccatgtctcagtgttctgtgattataagatataaaaaggcagcagcacataccagcactaaaggacaggaagaactggggacaggagaatagctattggtttagacatacatcgaaaaatcaccttgaagaaaaatgagcagaagaaaaatgaagcctattccatcttcagctctcagggcccagactccctccacctgatatcttaggattctgcttctcaaatgggaagaataaacatggcatagtttccaacagtcaattgtgctcaaaaatgtaaagaagaaaatttgactcttgttctaaaatcaagacatattttagacttagcatgcaatattctcaatgtattttagagatttaaaaatgaggacttaaagaaagatctggcttgtgtgggctttttgtcttatgggtgagtcccctgggtgctcattcaccgtctcccagtgtgaggagtatacttggagggaaagtttcactgggcatctcagagctttagccatttaaatcttgtaaagacagaagcctatttatcctgacttaagctgttctaaagagacagaaactcaccattggactggtcttctccatagtttttatgggatggtgcatacaagaacatcagagcaaagacatacagattccacatcccatagatgcctgtgaaaaaggcactgttcacttggactgtgacgccgccccatttccaatggccttccgttacctgcggagaaaggatggtgatattcaattgaaacagagaagaaacagaagaaacataacaccaataaaggaaccaaccaacatgaaaaccaagtctcttctacatgtgggaaacatgaagggccatgtaagactccatcttttaatctgaatcatttcggtgtaaattaaggtcaactgaaggttctctagctttctgtcaggcacagtcagtggtccttaccttgcccacagattagtatcacctggggagtgtctcttcctaaaaacagcaattcattgctatccctaagttaaacaaactgtgtttgagcccatcacttattcacaattataattcctcctctgctgtctgtcttcccagctagatgtcaattccctgcaggcagagaccagttctctgctgccatgtctttaaggcctgatgcaccatagattaattcaaatccagtgtctaccactcactcggcttaatgtaagacaagatgaagactccagacttcagaacttcagtgtccgtaagtgtaacataaaagcttgcaggttatcgaagagaattaagtaaaaatatttctagaacctgcctggcaggtactcagtaaatattagttatttctataacatcccttgaagtaagccactcatgaaaataattatgaagctttcatatgcttcaaaattctgcaagagatgttttgaagctgcttttgtctgtgttaatgatttggtaattgtcttaagggctgcctaaagatatatggattacactaagaactgtcaacagagctgctgagctaagtgactaatttgtgccagctctgagacaaatgaaatgattttgaccacttctgcttactacgggacacttaaaatggaaatagaagaaagtattgggtaaatattcctttgacagctgaatgaggctgcgttgtataaactttctctaggaatcacttttaaattgtaagatggcaggctagattgaaatgttaagaactttaacaagcaggtggatttcattgcctgtttatgatacagtgggtctgtgttcattatcttctgtataatccataacccacttggggccctaggccaaattaaggtctaagtataggtatttttttctgaaagaccaggagtgtcagttaaccacattagccaattatagacttagcagttttagtttggccttggtgatacataattcttcactttttgtgactcataaacaaaccactattatgaactcttatttattttggaaaataatgcattttatataaaatgcccagaagtgttttctggcaaagatggatttcataaccattactaattttaggacaatgtaccagcattcaagctacttaggacttcttagaaatgtctccaaatgtcgctcttctttaagtgcagaatatactaactttataaaaactatattacttagagcatcttatgatgatttttattgcatataatggaaaggaaaagaaagcattaagatagtttccagaaatacaggtacctgctgtcataacacagagaactcttctgtatgtgattaaggaggggaggctaggctgtcacgcatcctagctgcaagagagaatatggcaatatggcagctcttctactctgttaaggcagtggacccttcagctcagggaagggccagtaagagaccctattcctgcgacagaagctggaaatactcaatattgacaattttagtgacattgattcttgctaggattgacatgactgacccatctaaggaaacaccaacctatgtgccttgcacacagtggtgctcgatagacatatgttgaatgaacagaggtaaagtacaggtatgtgtagggactccaggacaaatacatggaggtagaaagtggagatggaaagaaccactcttaaaagtacttgattgaaaagtaaagacaaagtattgcagtccacaagtcataataattgaatttaaaagtgagaggagatgccaatgtgtgacaagtgttattcatttaaaacattgctttccgttatacttatttaaaataagtggttaacacaaatattagcaaagctaagattcttttgtattcataacaaggataagcatatttattcaatgctaatgatgtgccagatacaatactaaatccttttacatgaaacacattatttagtcttattaatgacgctgtgaggtaggtaggtaatatttccattcaacacatgggtaaactgtggcacagaaagatggagtatcttgcccaagattgctcagccagaaagccatggctctgactccaaaagaaggtattcttaaccattatacaacacaagggtaggaatgctatcttaaacaggggttgatctctgaaggtagcacatgctctgaaggtagcacatgaggcaacgactatgtaaggtcaaatttccttttgaaattcacttcattgcccataatgtacattacaaatacaacatacatgcacacatttgtctattcaaatctgtatagtatgcactatatatcctggacatagtaacatatggtataaactggatatataaacaaaataaaaacttacagtagaaccactggaatgagatgcccatagtatgagaggcacacaccaagcctgacaggaaatatcagactcatgctcccgtctcgtacttgctctgggacacatgcacattgtttagagtggagttgcagaattacacaccctactgaatgtgcaatctgtaaatgtggtgtttcctgctgtgggcaaagagttgaactgcagaaataaacggtatagatagtgtaactctgctctttggtggctggcttgtttttccctctcctctcccaattattcatgcctaagacatcctcagctctgagcacattcccaccaatatgtaccacaatgagcagcctcaacagagcaggccttgtaaatccaaaatcttactaatgccaaggcggaggtaacagtctccccccttttaactttgagagaaaaatcaggtagccccagcccccctccgccaaaccctcccccctcctcaaaatccccaaatctcaccctctgcataagtcttatttctaaaagtccctgtttttcctgattttacatttgaacaatttacttttgtgtgaaaccacccaattatacccctggagccaagtgaaggtcaaatctctttacacccagtagtcttgacaaccaacattccacttaacaacaagatttccaaatcccagacacaggctctcttaccggaaacatttcctctgtaagtaacagaatgaagtgatcacacacacacaaaagagctggggacaggctctctgggagtttgctgcatgtggcttgacctgaatgtcaggcacctgggggtccccttaatgaaggtcggtgaccttctcccctgcactgcacttctgttccctactgccgccacctctaaatggaacgcctctttcttttccagagggaaggggctgaaataccagactgcgatgtaccatctcttggttgctatgactgaggccattaaaatggcaggcattaaaagactgcacctcagtacccagctacaaagcctcaaggtcactgcattccacagcttcccgtcgcctttcattcctggcctcagagcttcaatatcctggcgagatcccctcgcattatatttcatgaggcttaaatgcaagctctcccacagcaagcccgagagtataatgggggttttaatacattccttttacctaaggctgggatccatttcaaaaagttacccaataggtttcctttcaggtgagctcattgctctgacattccaaaatgacattaaaaaataaatcctctgatgactatattaatacagtacctgggacactgagagttatgccggaaaacgtcttagatgtctataaataaatcttagaaaaaaaacccagcaggaggaatgtgaggagctaatggaattcaaaaggcctcattgctacccccttagagttgaaatccactccgggccgactgtcgcagcagatataaaaagccagccacaggctgaagctgtattagaaaatactgaggcaatagaatattaatctttttctccaaagaaaagccacggactatgctccttggaagatggcttcctttgctataagaagtacactaattaaacatgtacaaggttaaatcctggcaacatgcagctgcttcagggatcagtccttcttgacttcaggtgggaggcattccccgcagaggcaagatatacatgaggcagtgtggggagaatgacgtcagcctcccaaactggcacaaggacctgtgtgtggccttaggatcaaaagcgtccttctttctgctttcctaaaaacatatcttgaaattgccttttatgcctcaacccatcttccttgagatgccgtttctccaaggaagtgctctgtgccctctcagccttgcaggtctggctgtgtcaagtgccactgtgcactactgagggactggaggaactgaaaagcattttggtcataggagggaatagccacgggagaagtcaggcctcagacactcttgtttgaatatggatgtttgagccttagctggtagaataaaacactctttcagagtttgaaatagttttactgcaaatggagtggaaagcgaagtttccaaggttttataaacaacctgatataaacacagcagtgttgtaggtcaaagcagatgtggtgaacagaacttacaaagacatatatgtgtatcagtttattttttccacgttcatttcaacctcagcagagctagcaacactaacactccccagtggcagagccaacaacagggctctagaggctccaaacttggggtcctcttgggtgtccttggatagaattcaaggggtccataaactagaatagaaaaaattatatattttcactagtctctagctgaaagataatgtttacttcaattatggatgtagaaaaatccctatagtgttagtactactgtgattttctcaatagaaatcatgatattttcacatcaattacagttgtagatataaatctgtaatatacctgtagcatctgtttcactgtaaatatatattacatataatatatagagatgattccccttgaaattcgaagtattttattttacttatttgaaaccattctaagaggagactcgtagccttcttcaggttgctaaaggggtccatatacaaaaatggttaggagtccctgtactagggaaacttcccagcagaatggagcaagtcgtgtcctaagacactatctacactactgaaatcctccattttggctaaatgacaaagcactggcaaaagagtcagaaggactgcgttctgatctctaacttattgcatgtcctttggcaagaaagacattcaagcttcttgctattcataagaacacagctactcatgcttacaatgtgccaggtgctctgctaactacatttggttgccacaatgatggttcagtcaacaacagaccacatgtatgacagtggtcctgtaagattataatatcatatttttactgtatttttctatgtttagatatgtttgaaatacacaaatacttaccattgtgttacaattgcctacagtagtcagtagaggaacatgctgtacaggtttgtagcctaggagcaataggttacaccatatggcctaggtatgtagtaagctataccatctaggtttgtgtaagtacactctatgatgttcccttaatgaggaactcacataatgatgcgtttctcagaatgcatccctctttgtaaatattacttcctgtagtcattacagcaaccttctgtggttctattgtaatatttattttgcagataagaaaattaaaccttagaactgttaagtaatccatccacagtcctatccagctaggaagcaacataaatgaaaactttctccaaagctattagatatcatagtctagcaagctaggataacaattcctgccctacttacctcgtaggatttttgtgatgctcaaatgaataatagatacattagatttaaacagtacttcccacccttcaaaacaagttatgaatattttaaaatgattgttattgagattttcaagtatagcaaaatgttgagttttggaaataaccagtgaaaagacaagatgctatcaaagagacttttgaattacatttcatatttaagtggcaatataattattacaaggaatagctgatggactgtataaggatctatgttaatgctagataaaaatggaatcaaatttatgcttgttagtgttgtgctacacggcttgataagtttttctcataagtaaataaaatatgtgcccttcaatctggctgtaggcttttaatttatttggaaacttttatctcctacaaggttttacggaaagagaaaatttagtccatttggccaggtgatatcaagacccagaaaaatatggcttgaccagctgtccagaattatggcctctctcctcctttcctcagtggctctattgaatttctgtgcagggtagagggatctctgcagagacattctcaccttgacatctcagggtccacttacctgactaacgatgaagaagatgacagtcatggcagcgcaggccaaggtgataagcatgaggaacttgaacctaaaaattagcccctattagaaaagaaagagtagtttaatactccatcagctaccaatccttttctcactatgtaaatctataaaaagcttaattttaaagaaatctgtaaaaccaaatccctaagaatgacagtaaaatagtttcccatagtaatatttcttctgcagaggtgagtgtggctgaaaatttcttgggccaagtatttcctatgttcttatcactcataaagcagcgatacgagagcctgggaaattatattcacaacacgtcgtgaggctgctaatttccctgctaagctggttatgcttctctgcaagggttcaaagttaccaaatccaagttttctgtggttgtaataaaattctgctccagtgaacaaaaagaaatgtgcatattaatcaacatgaagtggatttggttgaattttctcatgtcactccagctctggagacaggcaagccttagaaagtgcctgtggtttcctaagagcaggatttaagagaacctgtgtttcagagagggaggcctattattcaggggctcttctgtgcagatctactgcatataaaaactctgaggttctgtagtttctgcttctcttttcatacaggaattaggcttgtttctccaaggacagccacttaggcatgaacccaggggatccctgataaatcaaggatgtgttgcttgcattggggatttgaggatgttaagtgtttctcttgaatgaggaacataatctataaacagagattactgaactctgtctgagcatctgctggatattttaggggaatgtggcctgttaagagtctggaaatcagatcacgtgggctaaaccctgtttaattacaggacagggttgattctgggacagaactttgactaaagcctcatcccaacaaaatcccaattatgccatagtccaatctcccagctagtatgtaacctacattccatcaccaagctgaagaaccggctgaacaagtttattcattactgaaaatggaaacacatttgtaccacagaaaacaccaagatttaggccagctagatgcttctcagagtaagatttggcctctaattttgcccagagatcctacatgagaatctctcaatttgtatttcaaagtaaaggctttctatctccagggtgtgtgtgtttacacatcaagtggaaagatcaagcaagcaccagttccagaacgagccaagaaatctgcccacctcatagtgtagccgccggactttgctcatagctggcaggctggactgcttcccactgatgttccgaaacacctgaaataccatgaagcatagaaacaggaagtagaggcagaggcagattccagccacgatgatgaaggccatctggtcgtgtccagtaaaggaaacaacgggctagccaaggccaagttgagccgggtccaggcccttctccccaggtctgttggcaatacttgttttgtctccaaatatgtagaaaattttcaaggggataaaatattaaaacctgatattctaatgccaatgataggtttcttgacacattagtaccacagagggaggtgttcaatattgctttctaaaccaagtaagaaaagaaatggtgtcttgcttgttagaaatgaagaatctaggccctaccctagacctaatgaatcagaatctaccttttaaccaggtccccaggagatccgtatacacaataaatttgagaagcactaataaaccatatattcgtcactatggatcagatgaaaaaccacagtaaaatcaccagaagggttcaaatgtagatccccaggtccctccctagatatatggaatcagatattccagggctaggacatcaagtatgactatgtttgggaaccactgggctagtccttggagttttataagaatgcgattgagatactctggcataattgaagaggagatacgtgggggctcagtgcaggggacctgggcatgggcttgaaagtcttaaagtgaaaccagggatgaaggactatttgcaatcttctgtcaccacagaaaatcttgtccaacagaatggggattcaaggacacatggcacaggtgggagtctgggttgctgccagtatacttgagacccactagggagactgacctgccaattagagccagtctgagaaccaccaagtcttaggatagcgtgagctgccttggaaggcagatgacctgattccaacccctttctgctacaactttgcccaaattgcctttttttttttgagacagagttttgcttttgttgcccgggctgaagtgcgatggcacaatcttggctcaccacaacctcctcctcccaggttcaagcgattctcctgcctcagcctcccgagtagctgggattacagggataagccaccacacctggcccaaattgtctatttttaaaagcatttaataagtatgaacttggcgtgcatatttcattaaataatataatatctaatgcagtttctccttctttcctataatgaacatcatcctggaatgaagggaatatagttattttctgcaggacttgaaattttactcactccatcctatctacaaaattaaaaaagttgaactagatttaacattagaaacattcttcttgttgtgcagctaacatttggtgggggcataacagaggaagggtagagcttctctctcatctttgaggaaatgatactactgatttagtttgctcacaatgttcttgtgacactgagaaaccaatataaacatcatggcaagacaaaggatattccctagcacgtggcaagatatgagccatcaaggaagaatacaacccaagcctttctctccactccagagcagagtctttttctcccaagatcatttcacatactattccggaagataaaatatttaaatccagcatcctaaaagggataagctaagactgtcacttctgcttcatgaagatgacttagagtttatgccaaccaaccagaagccttggcgacttctctggaactaatcaccttagccttatctccacttggtctcaggaataaatagcagcagtgtgatttgccagcacaccaaggtcacttaagaagtctcacacataggtggtttcagaaacaggctcttccacaggggcccagagatgaacctccatggctccagggaaaagctagtcatgcttcagtctgcaggaaacagtgtataacagataattcagacaggctgcagtaagcctagcaactcggatccctctgctgtgaggataggctgtgaccttctcattttgcctgctctcacccaggcttgaaagcaagcagtaattcttcttattattagccttaattgtgctgttatgattggcctgagaatcaaagccctggctgagtacatatggggagcatcagcagagccttagaaaatgatcttggggactgggtggccaggggaagaaataaaaccctgagcccatcaaggaaggatacggccagctctgttccaatgtctgtagtccagatactgtagaagggattcgtgagttgtacccctctacaaagaaaatgagatggaaaggcaagacacaattaatacaaaggcaacgggaactttccttttcacatattcttagcttttcagctgcaggggtgagggctgtatttaggctaaaaaacattacagaaatcctaaagagaaatgaagcttgtagaatacatcggcccaaatatttttcaactgtaaagagctgtgcctttgatttgatcccagaccttgtctgaggatgtgaccacgtccagtgcttccaaaccaaaggttcccgaccaccattctccttttcaaacactcctcctaaaatgacaggagtgggcgtggtgatgcacagtttggctcagtgtcccacaaacacttgctcacctctcacacatgtcaaatatgaagaggcagaaggagccaacggcaatgggtccgacttgcttccaataccctgcgatgtggttccgctcgtgctgatcctgaggaaaaccaaattgagaagggagatagaggggagaggaagaccaagcaattctatgggggagtcagcattcgaaggacacttgccgaccacctattgtgtatcaagcactatgctagattctaggtatgagaacaaagaagatgaaaatctcttcttcaggagctcatctctgtgggggagtctggcacatacgtagaacatgacaaagcccagccataagggctctgagagtaataagaacaggatgccatgggaacacaaagaaaggcctcggctcccaggcaggggacattttgtggtccacaaaataactcattctgaattaaatttctacgtgacttgtaacttgtgtttataaaagtgactgatcctcagaagacaaagtaaagacattaaagcatttaaatatgtaaagtgtgtctattatggtgaggaaaataggcatattttctccccatccttattaaaaccaggaatgagtccccttgataaacaaagacaccaagagaaagaaaaggaaggaatgtagaatgagaaaaaagggaaagcaaagatgatcttagcctccaggtggggccccaggtgggtcagtccacaccagctccctgcggacaatccttggctggcttcctggtgctggaccaagttccatccactcccccgccctgctgctgaggcctcattctcagcgcatctctgctggaggacacctcatggagaaagaccccttaatgtagacagtttagcagtaggaagaagtctctctctctgctctcacactgctctcctggaagggcagcaggacttgagaggtctggttttcatgattgagccataatggaatttaaaaacagtccactctgctgtgaagcccatgtgcctgacgtgaagaccaagttccagctggcatatcatcttagccacaatgtgatgatgacaccattcttatttttaaccatggtaccttcaatccctcttgaaatatgatttggtgtctgtgcaaactgaggagaccgggaaggtctgtatttcagagtaataggggttactaggccacctggacacattgccagctggaaagagccaggcccacattctctgatggttaacctgtattcctggggacaggacaagcagggcagaagccagcagacaagaaactcaagctcaagggcaagaaataatactaatcattagaatgtgtgtgtttatcttaagttactcacattctgtcatttaattctcatgaaaaccccatgcagtaggtctttacatcccattttatagatgagggacccgagattcagagtgataatgtcatttgcctaaagccactcagctggtcagcaggtggtgaagcaggaatgtgaaccagagggtctgcctccagagttcccacttgtaactactagtttattctgtctcacccactgctgactagaggcaaaggggggcaggtgtcagcttggcagcctgcacagagcagctggtacagacgtctgtccctcccggcggctcttaccatcatgtgctcgccacagaagatgatccagaaggacagaagcatcgcatagaagatgccctgtcggatgtcaccaaacagcagcatccaggtccagtcaaacccgatggaaaaccattccactgggatattgataaaggtcatggaaatcccaagggcaaagatgactctgatggtgagaaaatatcaggacagccactttattcatctggaaggcagattttcaaacaattccccgaattcagttttgagacatgagatgttacttattgggtctgaagccatatgatcaatttcttctgcacagagatgcaaaacgtcctatgtagttggcactgctgcagaatgagggagtgctataccaacctttctatggaagtgaacctgacctccttaatgcctcacactttactttggtaccactgcagatggcagtcttcctataatgtttgtgtccccttgccttctcacccaggcctcagtgagtacaattgtcctctttcacctattcaggttatcattcatctgatcattaagaacactcattattattgtgatatcctcagcaactatgaattatataagcatatttgtttcaataatacatgactccaaacacatttgaaatgtaaattctcttgactgcttgtttagcttttattttactcttcccctgtcacactaagaactgccaattctctactaaaatataattcttaagtcactgatttattcatacttttttccatccccttgaaacacatatgttaattaagcacagatcatgtaccaggtattgtgttagcactatggaatcctaaatgaacaggacctgttttttcactcacgggagatacagttagtagaggagccagataaagagacaactgaatagattaggatcaggaacatcatagagttttaaagcatagagggctgctaccaggacttctgactttgacacagacaggaatggagctgacttgtgagtcaaagtgagggaagtggaaagggtgtttggaggagagggcagagcctggatggaggcatagaggcctggaagaacctgctgcatttggggatctgcatgtggcacatcaggaaatgacaggacatgagaccagagaaacaaagagggctgtgctcatgaagaaacttgcataccccactggagaactgaaatttatcttgaagagactttttattggaatccaataaaaagtttaaacaatggagtgacatgattcattcaaaaaatatttattaaactcctactatgtgtcagtcactattctaagatgctgggaatataactgtgaacaagaaaagcaaggattgtgctcttgtgatgcttgcatagagatggaatgagagagggagtacaagaaaaagataataaatgaagaatgagcatcatgaaaaaaaaagctaggcaagagagtggagagcaatggggatgtgattttacgtaaggtggacagacgaagagatcagcaggtgtgaaggccctggggtgtgggtttgagcacaataaagggggctggtgggtggtggagaggacaagtgacaagatcagaggtggaaggcacccaatcatcaaggggcttataggtcagggcaaaggagatgaaaagccagtggagagctttgagcagaggggtgacaggatctgattaacacttgaaagggggcactcctggctatcctgtgaataggctgcagggaggcacgtgatggaagcaaggaaaggggttgcgaggctgttcccactgatccaggtgagaagcgatggttggttagttagattagggtggcagcagtggaattggtgagatttcctggtgaggttgatgagaagtgtgaaaaacagagacatacaggatgactcactgctacatttccagtctgaacaactgaaaggatggagttgccttttactgaaatggggatcctgggagggaataggttggaaatgggacacaatcaagtgttgttcttggtacatgtgacattttcaatgcaaatgaagacattaagtaaagagctggaatatttgggtccagagttgggagaggctgaggctaaagatacagattaagagtcatcagagaatagatgatttttcagaccacaaaggtaggtgaaatcaacccccctagggaaagcacagctaataaagagaagaggtccaaagcaggtgccccagtcccaaagtctaagagtctggaaagatggaaggagacaggaatggaatctaaatgctggtcagcaaagaagaatgaccaacagaagggtagaggagactctgggaagaaaaactgatcaattatgtcagatgctgggatgaataaaaaaaaagtgaggaacaaaaaatgacctttggatttggactatgaaggttgttggtgatcccgtgaaaagcagttttagtagagtggtggagatgaatccagactggaaaggactcaagagagaacagaggagaagacatatgcacaaggtttttgagaagcattgctgtaaagaggagcagaaaaagggtatgtggcttcagggggaagtgggaaatgggagaattttgtctaagaatgggagatggcaggacatgtttgtatattaatagaatccagcagaaagggagaagtcaatgatgtggagagaaagtaggtacatctacaggagcactgtctttctgtaagtgagaggagctgggcttaggggagtttcttcactacaacacagacaagtatctgattctgaccacggaatatcccgaagagcaaagacaggttaaagaaccagaaaggtcagctgggtgtggtggctcacacctgtaatcccagcactttgggaagctgaagcgggcaaatcacttgagctcaggatttcgagatcagcctgggcaacatagggaaaccctgtctctacaaaaaatacaaaaaactagctgggaagcatacacctgtggttctagctaccgggaggctgaggtgggatgaccactggagcctggaaagtcaaggctgcagcaagctgagatcccagcactgcactccagcctggacaacagagtgagaccttgtctccaaaaaataaattaattaattaaaaagagccagaaaggtgagagaggtagaaccccgaggatttacttaataacaacttgcataggaaaactgcaggagaaaaaggagtccaggatgactcctggtcaaatcactggcctaagtcacacactggctgcttgaactggacaccagcaaaagcaagagcttggcagatcatgagaagccagtattcctgaagagcgctccaaaaccagctcttacttttccagaagcactgggggtcgggacatcatggtgatcctcctccaataccacaccataatgatgaagatgctgggcgtaaggaaggtcttcatggcaaaccacaccttggtgaagcctccattttggtggatcccctaggcagagaccagtgataattttgaaggtgaatattatcttagcatttccttctactagcaaatgcttttgtgggagaggtaagtggagacctcgtctgcgaatgttcacgatcaagagctttcacattcatagcaggtactgccctcatacacccttggactctcctcagagataatagaaatacatattaaaagagccctgtgctatggacctgagaccagagaaataaagagggcatcccattcacaataacggctttcatgttctggggtctgaaagaagaacatggggctttggggcagggtcactatttccaagagacttcgaattatcttaccttggactcatcccactgatattaaaatgctaatacctaaagatacactttagaggtacggattaatagggcaggtatggattaatagggcatacagggtgtatgatatctacccagctaccacccccacagtgtaccccccaaaaaagccacatttgaggtagaaccagaaatttcaggtaaaaagcagagatatcctctatctcttaacacctctcttggccgtttaatcctcattctaccctcacatcttactaatctggtctactaaggctacaagagctttttccctatgctaagattacgattaagtacatgatcaattttttttgtaagcttttcattagaaagttgcagatatcctagatggtcaatatgttgagattggtaagtgttaaggtaaatctattctataaaatgctaatcaatattggaaagtatatttatattacattcaccaatttatattacatataccattaaataaagaaagcaaggaaaacagtcagttcaatatgatcctactttttgtaagggaattactacgtataaaaaaaagcctggaaggagatatatcaaaacctgaacagtgattatttctctaaatagtaggacattacaggtaattattatgcttttctgtgtctctacacaattcttgtgggactttgttgagattgaaaagaaatggcctccttgcagcaagttctaacttttccccaattaaacaaatatgatggaaagaacctaaaccacccctattccttttaacatttgtgcttgcaaggtgaaacacataaaaaagaaaatttacttttatctcagtgttattcattatgcaatcatgactatttcatgatcttatcatcattgtaatgatcttaagtgatcttaagcccatttaaaatcttaagtgggcacaataattgcattgtttcccatttctgtaatctctcacacaaattagttcactttatgatctcagccatcatgagtatgttattattcccatttctcagatgagacaggtgaggcatagaggtgccaagagtgagatggagttcccctccaatacacatgtcaagatcaattacattcacttaccaccaaccggatatcctttatctccccaattcccacattgattttcttcttctcattcacaggcagccggatgtttaaaaggtaaaacttatgggccacagacccaatttccatgaaaggaaggacatcacattcatagtaacggccctcatgctctggagtctggaaaaagagcagagggtttgaggcagggtcactatttccaatagactggctctgaattctgttaccctggatccataacatcaattgtaagcagctaatgcttaaaggtacactttagacgtacagagtaacaatgcatactggaggcatggcgtctacccagctatcccaacctaaaacaaacatcaacaacaacaacaacaaaaaacagctgtattcaaggtagaaccagaaattttaggtagaaagcagagataccttccttctatctcctaacacctttctaggctgtttaatcttcattagaacctcgcatcttacgaatcttgtctgccagggctacaagagtttttatctgcagtgtgttgtcagggtcctctaaggctctgtggaacagtcagcttcttaaacgttcaggtggaagctcttgctgaatcattacactctttaatgacggctaattattctcctgattttggcctgagggagaagctagaagaagctgaaaatatcttctttttattcacttgccaggaaaaaaaaagacacaaggagccgttggtatttagggaaggtcgaaacagaagaaagaaagataataagattagtggccagagatacccactaagaattttctgcctccggtgcttcctaacagtccaagatggcagaagggaatagaagttttaatgaaataagaatttagcccagtgtctaggaaagcctcttggacttcgtgccaaacaatttaagagatactgcccagagcacggtggtgggaaattggacagtagggagacaccttttttttgaaaactaaattctgctccacctcaccaggactcccggctgtgtacctgctgaggggtgggggccaggggtaaagatgagcataaagaggcatgagcttcagcaggccgggacttttccctgatatagaagatgagagtctaccatcaatgttgggtttctatgtcagcttcaatgtttccttggcacctcctgatcaagtgataggggagatctaatttgtcgttcctaagcctgaatttgcaagacctccataatttgtcataaatcttcagagcaaagatccactgaagaagtgagaagaaagaagataacaaagagtccatagtctaagagtatgtaggaaggggctaggaaggggctctgccccttctgagatcttggctggtggggagggttccttactgaacagtcagagcttagaatgcagtaaacagacctttgtacagagacagagacacacacggcaaggtagaggtggggaggtgcttctacctcctcttgcccaccacggcacacataaccaatcagtcgtcaacagtttttatccctaaggtgtgagcagctcttgtcagacacaccagttgattagagttggcatgtgagatttttaaaaattcttctgtagaaagaatgctgctttttcaaacctcagctgcaggtcagatgattcttcctatatagatcatctttctctcccctccactcctttctctcttatactttcaaatcagggaggatgggggctctgcaggtactactaaaagttcactgcaggctctaattctccctcagattaagctgcagtgaggaggctgattatcctctgtggtaacagcaagagggtattttctgatttgtttccagttagggccttattttattgatggaaattgagaacttgagggcggaagggaacaaaacctacttagtctaattccatctggtgtgtgtctcgcccagggtcccaaaagtagtagcagaattgggagaaggacatgggccctgcccaaaggcaggcattgtgctgtgataaagactcctgaactccaggccaggaggctgattctagtcctgaccatgttccttgctgggtaccttgggtcaccctgcctcatttggcctcagtttcctcctaagtgagaaagttaagtaagatgatctccagggtcacttctaatcccccacgatgggtctctgggtgccccacacttccctgtcactactgagtgagtaacatggacacccttgacacaaatttacctaagttcaaattaaaagagacacattggcatctgggacactggctcaaccttcctgtctcagagacaagttcgttgtatcctgttagagacttttcttcatgcactaaagtcctgcctctgccagtatttagggcatttaagaagattcctctctctccttcctttgccccacccccagttctcccccaactccagcatgagactagctcattaggacaaattacagcaggtggcaacttgacttttttttttttaacttcacaatccaccagggactcaaaagctttaaagcaatttctcatttaatcttgagactcaagactaaatttcactgcaatcaaaaagcagagacttgatgattcatttccttcgcacttttcaagatttaatatctttcttgcaagggatcaacacatcctaaagataattaagcattaagaagcagttgcaggcaaacacccttccccctcgctactcagtgccctccatgtgtataaatgagaaatgacttttcccttttctatggataaaattctgtatccgaaagccatctagcttagatgttcaaccagtatttcaaagatgcagtcaacttgcagagatagctagaaaggtttttaattttcttggttgcatgcaaagatctgaaaatgttagctgttcctctctcctgcttcctctagtttgtctatcattcatttctacctacaaatggctttctctggaggacagccctatatttagcactcagcagagggtctagggcagtggctctcaaacttcatagagtttaataaactgaaggcctgttaaaacacagattccttgctcctacaccctgagacattgacttaataggttctgggtgtgccctgggaatctgcctttcctaaaacctctcaggtgatgctgccactgttggttctcagaacacattttctgtagctttgttctaggaaacctgcgggagggagactcccctagtgtttcaaaaaacactgcaatgggtacttaggtttacccatggagggccttagtttatatgttttctcctagtggcccatctggttaatatccgctttgactctcaaatatgtcccagacaagatgttaaattagaaggtcatcctgcctacgtcattgtatcatctagtccaggggtgtccaatcttttggcttctctgggccaaaccggaaggaggagaattgtcttgagccacacataaaatacactaataatagctgatgagctaaaaaaaaaaaaaatcacaaaaagaaattataatgttttaagaaagtaatgaatttacattgggccacattcaaagccgtcctgggctgcatgcggcccgcaggcagagttggacaagcttgatctagcccttaaacagactcccaaggtaggtactcttatctcatcttgcagaagaaaaactgaagctcagacagattatgtaagcttacctgaggtcacaccgtcagtgataaaaccacctaatctttctcctctttaggaaaaaaatggctaaagctggggcaaggtactcagaggcttcaacctcatgtttttactattttgcaggaaatcttaacagtaataggcaaaagcaaagttaggaaaggcccgtggcaggagagaagaggaaataaaatgctccgcagagcaggtattaccaaagctgtcctcatgcgaagaagggacacacctatgaaaagtaagcaaatctttccacatacctgagaaccaaataaaaactgtcagcttagacagcaaggggtcataccttgggagatgtgaaggtgcatttgagtttccgtggtactctttcatgggccatttcagtccactcagcaaacgcgtcatcacggtaagccagggaaacgtccatggagacttctgcattttctcctgcaagagaaaggatgcacgtttcagaaatgacttttggaaagatattttagaaacagctcaaaaaattcttataggctttgacttggaaaccaacgagacaaaagggaaatattaatttctatcaaactccaaacctgaagacttagaagtcataggatgaaagtctaagccaaatgctgggtcccctctcatgtccactctgccagagtcaagagcctccatttaaactcttccagagacaggggcctcactctctctgagggagcacaaatggtcagacctcatcctcccataacttgtaccatgggtcctaggtctgcctgtagaagccacgtggaaggtgatgtccttccttcttccataaaaagtgccttatgttcttgaaaaccataccacatctgcctgcattctctttcctctctgataaacatgaccaagtttttcaaccacctctcagacacgtccctctggggctcttctctggtcacactctgtctgaaaacatccttctcaaacttattcccgaaagttctcaaatataggatttgctacttttccaaaagtcaaaatcccttcatattgtggatgaagttaatgtaaaaggcaaagtgtttttccaaaattaaagacttatacacagataggaataatacataattgcacaaatgaatgttcacacatacttccatatgtgtggactggaccacgaatgagttaaactcaccacagaactcattaaggagatgagattaataaaacattgcacctattaattttgtctgttttatactatgatgagcaagttcaagagcagagaagtcttttttttttttttttttttttgagtataaaggtttaattctatttaaaaagaaagtccattaaatcaacttcaagttcttaactcatgggactattttggaacacttctttgtaaatatcattttgttaggttattggcaaaacagtttcaaggttcacttccctcccttgaaccaggtccaggtcattttgctttggggtaaattaaaatcagaattctaaaagttgagcaactttgtttttttttaattgacttagctctaacccaccattacaacttaaggacggcatgacttgataatgatggacttgtgtgaggttttgagttttcaattaaactttgtatcacatgaggtaattgtcagcattcttgagtctggttatggaataggcagatagaaccctgtagtaacaagagttggaaattggctaattgacaacgcacttgccttaaacatctcaagtagagaacttttacattagtgagatgtacttgaatttcagaactcaacaaattttaattactttttactgaaaactgcagtgaatgctaaatgtctacgtttacaataaacaaatacagtaacagtaactcacactgaaacaaaacatacttctgatagccattatttttctgcttgggacaattttaaagtttttcttttgtcacaaaaacaggaatgtatccaaacaaaggctcaaaagaggccatcttttcaaacaaaaaggcaatgattcacaaaagactgtgaatagaacatgtaactagttgatacaaatctaataggatttgttaaaatcagtcacatctaatacatctgaagtgctcttgtataaaatatcacgtgaagaaaagaagactttatcaatgtctaaaaaagtgggtttgttcatagacaatctgacaagttaccataaaaagtgtttcctgagacataaggaaatgcaacattattcttcttgaaccgttttagctcaactttccactcaataaaacagcagaggatctgaaactgagaaaatgtatttgagtacaaacagcttgtgaaagttaatactttttttttgcatcagagggtttttactgaacttacaaccaacttgcccactcagtatgcagttcagatgtgagagatgcttctctgtacaggagcctgtactgtcttcaatcctatgcgagcaagtgtctaccacaggcaaacagttttctccccattttgtagtaatgtaattttcctattagcaaaaggaggtcaccagcccctgtagacttaagggactcaagtcacaggatggggatatcctcttaatattttttattttgttgtttgaactcttgatgcaacattgtagagcagggtgttcaggacctgctgtgcccaagggactgataaaggaaaaagctctatttattctttgtgatttgatgcacagatgaaaaacttaacacacaataacagaagttggtcgttaataaatcacatcctagtctttcagcgcttccgtaagcagacgacatcttcagttttctagctcttgtagttttaacactgcagcatcaatgatgcataagtccagaatcagttacaaagaccatcatattctttttctcttagttcatcatttttcactatctcttggtcccaaatgtatctgaatgattaccttccggcattctctgctattgctcgttggagtgctctcgattgtccccgtgttttgtgggctggttgggagagggcgcctgggaaggatgtgccactgttgggaggttgtgagtcactgggatgcctccagggatgatcccttccacggctgcaggaagtcctcctggagccacgcccacgatgcctggcggatatctgtatgtggcaccattgagctcaggatgaattgcttgctggtctattactgaccaaggcgctgatgtgacagagaattccttgttcacacagtttcttaagctttctgggatgtgacctgtgatggctcggcggatctcagtggcagctgcctccctcatctccagtgacgcctgcttgctgtaccaggcagtgtgaggagtgcagataagattcggtgcatctttcaacggaccctgagcaaagctaaagggctccgactcacgcacatagagggctgcccctcgtatcctgccctccttgagagcttgtgctaaggctttctcgtccaccaggccaccacggggtgcgttcacaaggaatgctccctgcctcatctgctttatggtaaagtcattgatgaggtggtggttatgttcgttgagattgcagtgcaaggagacgcagtcgctctgatacagcaaatcctacagagtgtagaccctctgcacgcccagggatcgctcgatcccatcctgcaagtaggggtcataaaatatgacgctgaatccaaaggccttggctcgaactgcaaccgcctaccccctgcgatcaaagccgatgaggcccagcatttccccacggatgctggccgatcccgaggccaactcgcggttctgctccatgctctgaacccgtgtgccttaccgcagtgcttggtacagccatgtgttcctctggtacagattgaggatgtggcagatggtagagtccggtgtctcttccacggctgcagacgggatattgcacacagcaattccgagctcgctggcagccttgatgtccacgttatcgtagccactgcctatctgcacgatcactctcggggccttaaacttttctaggtcctccctggtgaggatgatggtgtggtacatcatggtacccatggcttcgttagaaccttctcgtggatttcctgcgtggactgcgcgtcacagaaggccacagtggccaggtctttcaggatgggcatctccacagtgcagtcgcggccgtccagcagcgccaccagggggcaggagtgcagggggccgttcatgatctgggggcggataccttcacaaattctgtccaattgctgtctcttgactttgtgcttatccacaagggccatactttatggaactttgcaactctcagatcaaaaggcaaagcagtcctctaagaacttaggggaactcgcaggagtctccgtgcatgacgccactatgaacccactataaatctgtacacactataaatctgtacactataaatctatagttcacacgatgggctgtccgtctttttaagggaatacagcttcattggttcaaaaccatttaaggtgatgaaaccctcgtcccggacggtcagcgtccacggcaaaaggcgcccactctggaggccgcggtggcggtggctcccgcccctcccaccccaccctgcggcggtggcggtggcggtggctgcagctgtgcagcctcccctcagcgcagcatggctcccttttcggtccctcgctcctccgggccgctcccgagccaccttaaaatgacgctcgcacacagggacacacaacacaaaaacttaatctctccagctccccaccactccccctccctccctccgctaccccgctctccccaccctacccctccagagaagtcttaatgaggaaaaaaaaaaaaaaagcacaaatcacatttccaaaatgactggagatcctgccaccactagggttatgaaaatgggcacaattttaggctctggctattcagccttgaagaagtctcagtatccaggcacctgagtttgctccatacccacctcctccagggctgcgacaaggattaaaagtcaagttagtgaaagcactgcatgctgcctcatatgcagtaggtgcttaataaatgtttactaaacctgaacacatacaaatcacaagggaaacagataggaataactgccctctgaaaagcagggcttttctacggtggcttaaagctgacatggcagcatggcagatccctggttctcagaagaaatctcggaaaaggaagagatgatccatggaagaaggaatttgaggccattctgatatagaggaaaccctcgatgaacatcagtacccactattctattattcctatttttatcctcagttaaacatagtgaattagccactgtgttttcctcctgaaattccacaaaataaagacaaagacagtaaaaagaaaagcaaaagatattaaatcacaaggggaaaaaactaactgtagacacatgagcagacaagagatttcatttttttttttttaagacagagttttgctcttgttacccaggctggagtgcaatggcatgatctcggctcactgcaacctctgcctcccgggttcaagcaattctcctgcctcagcctcctgagtagctgggattacaggcgtgcaccaccatgcctggctaattttgtatttttagcagagtcagggtttatccatggtggtcaggctggtcttgaactcctgacctcaggtgatccgcctgcctcagcttcccaaagtgttgggatcacaggcgtgaaccactgtgcctggcctcaaaatttttttaaaacataaaaaatacatgaagtagggtttcctggcagccacagcctacactcctatagaggggatattctagaaaagtgagccaacatatctgcaggaacctgaagccactcagaatttgaaagtaccaggggttgcagaaggcagaacaaagcatggcactgacaatggggtgactgggtcaaagtctgcacacaaaactgctggacctcagttctcccacatcttcccatctgtgcaagatccaaggagagactctggacttgaggacaccaggggaatatgtagacccagggctggaggtggagaagagcaagagtctgtagaagaaactgtgccactcccagcttggcagaaacaatgttcagagttggtatctccccttggtcagggaccaagctggctacaacttctccccacttagtagcctcagtggtcaacagaaagaatcagtcagagctcccatggagtcaaatcttaggcaataaagtacatcctacttataacgctgggagtaggaattgggactttaaactgtgttgaaaagggtgcttggagaaacacaagagtataaatatgaaaagctgtaaaaaatgtcatcagctcacacacaggttacaaattactcacaggttgttctccttggagccatagggttcagagcaacactagccttagacacaggcaagaggggcctttgaagtttgggccccacacttttaaagggtcccacacttttaaagggtcccactctgtcaactgttcccttctttataggacaagaagactcccaagtgaaggggatatatatacccagagcctacagaccccctcacttctagaccacgctccgagatgtcagactccagaacattctgcctagacagctctgaactcttatcttacttccaaggtctgtgtggcctctttccaggtctggcttcccaagaagaactagacaaccacctgtatactcttggatgttcggtgggggtgggagtgaaaaggctgctatttgttggaagatatgaacagagcttgagctcggaggttagggtgtccatgtagaagcacgcaaggcccctctctttatgggatggagccagcggtggggagaaaaggggtgtaggggcccacacttcctgaccagtcacattttggcacagaattccaagtcgtccatgagtcctcaattcgaacctggccatcctgttcattatgcaagtaactcatcatcagaggatgcaacgtacttggcttaacagtttgctggcctgatttatcacttctaaatatttagacacatgataggcatgccttcattcatactgtttccccaagccagacaaatgtttgtagtgggcctggttcagagcaggtgcctcacagagacaaggctagataggattgcttccttgcctggtcccagcttcaaaagttattctaatctgttgaggatcctcaaaggaaaaactattttaaaatatgcggtttaaaatgaaaattgtgcacagtattttaatgtacaattactccatgttaagctcctgtggtttctgtgctttaaattacctcatttaatgttcccaacaattccatgaagtggacagaatattttattttaattaatgagtaaagtgatgccctcagatcttaaggaacttgtataaagtcattgaaattgccttaaaataaaatcacttttttggtattgcttaaagaaaactggctaacttgtgatagaagaagcccctcaaagcagtcacacaatatgaatatgctaagtctttaataatagcaacagctctccttcatcagaggctaacatgcaccagccttcttcaggcctcacatccatcctgggaggaagacgttatataaattgcccaagaacatatggctagtaaacagcagagctcaagtctggatcacgtaagggccccactgcactctactacctttgctggtgaaaacaaacaaacacagtagaattcaaaagaagctaacagctgaatcaagcatacttggtcaaagagccactcaacacaaactaaatacctttccagctttctacaggagagaaacaggcaatgttcctgggaggctgcaagtatggctcataagaatgtctggaattatctaatctaagctttctaaagccatctattgttggctgttaaaattatagcatgttctgccgtctcttcacgttaccatctccttacttcccgtgcaatctgaagcagaggtgttattcctgtttatgaggtgaagacgccataactcagaaagccctaccctagaaataccagactcaggaccctagagcttcatagccaatagtctcatagcatcctgccatcttttatgatgtacataaaaaaatagaaatcacagggagaatggcctgttcaagtgacctttactagactgtgatatcactcctcacccccagacagatagcacacatgaggtagcacaggtcaatcttagcagacctggttccttacctgttaggataagacttaacgcctagaatttcatgattattacactagttactgcatgaaaaatgctcaagacagagcagaaagcatgaagggtaaggtattgttgttgacattttattagggaagtgaaactcttatccttaattcaaaataattaccaggtttcaggaacatggagcttcccactatgaatccctaatccaaacctagatcacaaaacccagaaacgggaaagcactggacagaggaatacagtaaaactgcgaagctggttacctgaattgttttctcttctgcctccagtggacttggaaataaagttcagcattaatgatgatgttgcatttaataaaacactggtttcatgactcctgggatactgtgtgggcaatacttcccctccaccctccagagataatgaaggcgaggaatccaatttgaactccctgggagaatggcaggaaggctaagctacatttggcactatattagaactttccctataaaacaaggacactggttatatcagtttcatgggggtacagttgtaaggtatcagcatagggcatttatagatttgaaatccatggttttccatacctatactataccagcagctttggtatagaagcccataggtcctatgggctagccaagcttcacatttctcaaatagctttggagacatattttagttgggtggagaattcattcagaggaggaagggaagtgtggaaaggcactgtcgttcgttacacttactatttccatcctgttatgggggcagtttcccctatgctccagggttccataggagcagacctagactgcaaagtgtggttacagacagaaagatccatgcctttccatgttgggaagcatcaactaattgtatccttaggaagtctgtctctataccagttatactgccctgccctgcttgagaaaagcaaagccaatcagtttttctgcaggcaagtggaaagtcagagaggagggcaagtaccttctataagccagaaatggtgggaggggggtgctagaaatcgctaggaaagaggtctagtgtccccaagaaatctagggcagctgcttaatgtaagaatggtccctggggtgggaatgtggggagaaggaaaagcaatgaaaaggccactagagccttaattgaggaagacatcagaatgcttgtcacctaagctctacaccttctatatttgaaacaggtatttcccagccaggatagtacaaagtgtataaattgggcaccaaatggatgtgattttgaattctccttttatgacttcccacctgaacaaccttgaataagtctcagtttccacctttgcagtatggaaacagtgggaactactccctaagtctgttaaccaataccagttccttctccatctagtcccagggtggctgggttatattgttgacctattaactggaataaaaggggaaaaaggagaggacaagatatattagaggaaatcaggaatgattttatggttgtcaaaagcttttaggttcctagagacactttgactttcctgggcctttgccctgggaaaaaaattaaagaggtttcaatgctcgtgtgcattcccacattacataggggagctgccagtcaccagagtttgtttgggtaacctcagaaagaggccacagagacaaatctcctcccagcctctggcagacatataatctggagttatttatgccagcattccttccccaataaaaaactctctgacctggcttgaatttttcttgacgctttcaattaaggaaataacaaaaccaaccctgtcttatacatggttaggtctggcaaaaatggactcagctaattacaaatttggccctggcggttttcttaagatgccctacaggcctgggtgtgagtggttataaaaatgaatgagtacaattattttgcaaaccagcctaacagtttagttcacattgcttctcgtctttcctcatcaaatcaagcatttgaattgcagagaattatcttccacatgtaagaaaacatatttctaagcattgcaaaactggttccttgctgtattctgatgcattatcatctggttgaagtcacatatctgtctatggaacatgacaaggacaagggagaacggtgctcacattaggttctcttcaaagtgacatgcagttagaaaacatccacttacccctattgtagccaaggctactagtacttaaatgctataccactgaaaaagtaagtggagacatcaatttttttaaataaatgaatctgaagtaccaccgaatatagaaaaaaaccatatctattgttcaccaggttggagagtagctctttcctcatctaactcaacacgttcaccctgaaggatttcatctgctcctgggatgcaagtcaccctctccagtccagatttccctcttgatatttgaatttgcatgctcacttttcaccagtctctcctctttcatggtttagaaatgcaaaccaccaaatttggtcaactctactaggtgtctttcagatttagcctcctctcctcactgatatgccgcttgttcaggccaccattatctccagcctccatgactaaaacacctgccctgttcctgtctaattttcacacttcctgctacagaaatgatttctaaaacactttcaatgcctttatattgtcttcagtgtgatattaagactccttaaatggcataattggctaaggtgttatgtagcagcctaggttctagttctatgaacgttcactaccccttctacctaggttggccacttcaaatacagcccctctcctctccagccttggaagatgagtaagagctcagctttggagacagacaggctgggaccacagcccaccttagctacttggtgcctatgcaatgttgggagtcactaaatgtctctatctgtaagatgaggataatggtaatggtaatgcccttctcctatcactgtgaggagtaaatgagataatgggtgccaagcactcagcacaggcctggcatatagtaagcactcagtcaatgctggctactatttcttttttttttttttttttttttgagatggagtttcgctcttcttgcccaggctggagtgcaatggcacgatctccgctcactgcaaccttcgcctcctgggttcaagcgattctcctgcctcagcctcctgagtaactgggattacatgcatgggccaccatgcctggctaatttttttgtatttttagtagagacggggtttctccatgttggtcaggctggtcttgaactcccaacctcaggtgatccacccgcctcggactcccaaagtgttgggattacaggtgtgagccaccgcgctcggccgctggctgctatttcaaggctagtactcaaggttatctacacctgctgtactcagggtccccataatcacaccaaattttatgaagagatgcctcctttgagagggtaaattacaaaaggcttctttatctgggctgcagacagtgcttggcatccccgctcgtgccagactcctactcatcttctggaattccccccagatttactcttgccttcttttactcacccaaactcaatatggcaccccccccttgctcccacagtaccttgttcacccagcaatatgacacttatgacacttattctccatgttgcttctcctgactacttatccccatctctctccctacccatctcctatttaggctgggttcctaaaagccagggactgactcagtcttgttcacagttatatcactcatgtctttgcacaatagatattcattgaatatttaccaaattaatgattatcatccttctttctccaaataactcttacaaacctaaatttcctgtcactctaccatcaaacaagtggtttgctctatattttggtgacattcatactttctttctccatcacctgcctttttacttctactccccccaaacccctgcacacacacccctgaaatccctgtgctagatggaccatccaactctatttttgtttccaccaaatatttttgagcacctactggtgtcctcgcacaagattggatgtaaagcctaaaaccataaaaaccctagaagacaacctaggcaataccattcaggacataggcatgggcaaagacttcatgactaaaacaccaaaagcaatggcaacaaaagccaaaattgacaaatgggatctaattaaactaaacagcttctgcacagcaaaagaaactatcatcagagtaaataggcaactacagaatgggagaaaatttttgcagtctatccatctggcaaagggctaatatccagaatctacaaggaatttaaatttacaagaaaaaaaaacaaaaaaccccatcaaaaagtgggtgaaggatatgaacagccacttcgcaaaagaagattctaatgcagccaacaaacgtgaaaaaaagctcatcatcactggtcatcagagaaatgcaaatcaaaaccacaatgagataccatctcatgccagttagaatggcgatcattgaaaagtcaggagacaacagatgctggagaggatgtggagaaataggaacacttttacactgttggtaagagtgtaaattagttcaaccattgtggaagacagtgtggcgattcctcaaggatctagaaccagaaataccatttgaactagtaatcccattactgggtatatacccaaaggattataaatcattctactataaagacacatgcacacgtatgtttattgtggcactattcacaatagcaaagacttggaaccaactcaaatgcccagcaatgatagactggataaagaaaatgtgccacatatacaccatggaatactatgcagccataacaaaggatgagttcatgtcctttgtagggacatggatgaagctggaaaccatcattctcagcaaactaacacaggaacagaaaaccaaacaccacatgttctcactcataagtgggagttgaacaatgagaacacatggacacagggaggggaacatcacacctgggcctgttgaggggtggggggatgggggagggatagtattaggagaaatacctaatgtagatgacgggttgatgggtacagcaaaccaccatggcacatgtatacctatgtaacaaacctgcacattctgcacatgtatcccagaacttaaagtataattaaaaaaaaaaaatactcagagaagttccaaatgctgtatataaataaatacaaatcttatatagaaataggatttggaactatatacatgtatataaacataaaaatgtatgtttatatatgtctataaagagtgaaacaattaaacttcttctataaaaaaaagagtagggataaaaaggcatataaggcaaagtcattgccctcaaattgtttacagtaaagtggtgaaggcaggtatataaataagtataattccatgtagtttgtactgcattagaagtatatatgaagtatacagtcagcacaaaaagatcaagagttctgagtagaaggtcaagaattgtagcacagaagacacaatcttctggctcaccctactgagaagaggtgatatttaccaatgaattgcagaataggagttcactaggcagcgagataggaaaaggcattacaggcagaggaagccccatgtataaaaagtcacataagcacaaaatagcagggaaagcaactaattcaatatggcagggaatgtgagagggactggagggaacagggaaggctagagaacaggaagggtctaatgacaaagggaagaagcttgccctgagtgctgcagcattttgcttagaggatgttaaagcaaaggaggagattctggcagctgtgcggaagacggactgggatggggggccaggtagacaaagagacatcctaaggaaactgaggcccactgctaacacagttctcagtgtgcttaagacgatttaaccttgtggaaaatactgccaggaggatattttctaaggaatttgtttaccaaagaatctgaacccaatgatgaaccaatctttcgctaacaaagctagagaactcagaaccatctaagttagcaagtgttaaaacactggaaagcaaatgtggcaacagcactttcctatttgaccataatcaacatcaatgtggaaagaaaacaaacctgaaagcaagtgaggaaaacacacagtgggtttctttgctttctctccaggacactgtcagtacacagagcatttagaatagctgatttgatcgttgtgaaaatctacctgcgtgcccctctctctctctctctctctctgaatgcaattagagaagacagcttcattcacactgtgtctaaaaatagatgatggcagagttcacagactgacagctgcattgtcatacagtaaccaggaaaggaaagggatggctaatttaacttaacaacttccaaaacaaacagtgcagagggagtccaggataaagaaaaaacacacaggtcagttcttcaaagagctggcagagggatggggtcgctccatggcagtttattagtcctcccaaaatcctgacgaaaccagctaagtattttgcccagatctacccagagtccttcagacaagagctctggcagatgaaccgctacagagattcaggcaatattaggcagcagggccaggactttccctgctgacttcttcatacatcccctggacacaagtaagctaagaagagtcatgacgtttttctaggcaagataaataaatgagttttttccccctttgccatatctaaattatactctgcctagcctggggcatttaaaaaaaagttatccaggaaataaacatgcatcattaaggggcagaaaccaggtgtctaaaagaagcaaaccatttctttccctcccttcagtcctaaaatgttttctgttttcctcctcagtctgccttgcccagggaagggattacggttgggcttcaaaagaaacaagggaataatgcctgtggacgggtagcagattctctctgcagctctcccgcagctccatgttggctctcagcgctgctgccagccagctaaatgtcagatcacggcaccccaacattccctcactgcatacctccatcgccctggtgactaagctgtttcaacagctgtgttattgctggagtcaggccagtgttattcacacgaagtatttgtttcatacggcttatgtggggaattattgcactcagctttggggttctatttaaagataaggtccttcccttgatcaatcagccaggacattcctcgagttgggctccaggagacagtgggacaatattctactgccacccggggttccagataatggacagattcataatactataaagaaggtggatgaagcatatgtgtgtgtgagagaatgggaagcataatggaaaaccatgacccttggtggagctgcggaagaactctgctgctcctccctcaataaaagccacccacaacacaagagtgttaagctggactccctttctgctcttcttctccagccatcaccctcagcctttcccttaaaatcattgctctttcctttcgggtcacgctagcactgttgcgttggtctctacatgcatcactccacacacctgccccgaatgccatctcctccctcagcccttggcttctcctatctcatcaaatggtttatgaccattgatgttcctatcatgtaggaagcaagttgggcctgttggcctggtgacctcctccactactccacatcctcttctgagtgtgagtaagataagggctgtgttactaactgctgagttaatcaacccaaactcccttatatggagggacaactgggaaaaggaaaaggcattacatccatgagctttatgtcctgtaggtgggactaatttctatttctagctcattctaggctgaatctccatcaaagaggcctactggcctgttctccctccaaagttgttctcaccaagagcaatcgggcaccattttctgatgctgaaaagatctcagaaatatgttttcttataaatgaagtatttttaaaagaaataaaacaatgattcctaagagctcacattttttactgcctactatgtgtagacattttcacccatgcagatgccagccagatggaaaccatcacaggcaatttcaaagtgaggaaactgaggcccatggccatgctaccaatgtgagagggaggcaaaatgagaacccaggtttgcctgactcagcagctcaagtactttccccttatgtctctcagtcatggggtaggaaagttaggacacccgcttcttgctctaaaaaggccactatttagccaaacaatttgagtaagtcactttacataatgtattatttcatgaaatactacagttggatcataggcttactaagatcctttctagttctaatatttcatgaatgtagaaatctaaaacacctccagctgttgactgccttctatacttaaggcactgaggccaaaacaaagagctataaaaccatgcctgtcctcagggcacttataatggagtttgagtgacaaaggataacaagttgagtttgactaatggaagagttaaacaattaacaaatacaaaaataccagagaaccagactacagggcagtgcttgagaaataacaccgcataccagcatgactatacaaggagaaaagtagatttcaacaatggtaacacccctaacccggaaaatacatttgtgctgccagcagaaagaaaagaagagacagaaaacgcttgcaggaaaagccagctactagaagggatcccgtctgtttcacaggaaagctttgtttctgacaagtttcgtaaaggaaaaagtaggctagaacaagcttttttatttccaacccaccttttcttcgttcccatgaatgaggaggggatacaaatgagagcaggcagccagggacaaaaataatatggctggtggttcctgacctcttggattcctgccaacagagaagcctgagaggcaacatttaattgtggaaaaaccagcctggctctcctcttatctttttcctctgtgacttaaacccacaattactggcaacccctagattccgagtcacccagctggtggtggcagcaatggctgtgtctgtagctgaaaagcaaaagggagtcagattttacctgcctccgaagccagccctgggagcacagccctaacccagcttgatgacttctcccattaaaaggttcacagatgccctcccgttgggaaaaccaccaagtgagaagtccagatgggaaaaaaagaaacacgattttcagctgctgtataattcaaaggacaagctacgagtctcaaatcctgaattccacattttatttcagcactagagatgtgatgttcaattccttttcttaagaaacaaactccaaatttcttagctggtcatcaaggcaactcacctaccaggccctctgtctttcagcagctcatcttttttctctaatatggacacttttctacagcccaacaaatgggcttaccgtcctttgcacatatgttatttcagagcatttcatgatagaaaaatatggtcttagtcctcactttctcacctagaaatcactttgaagaagtcacttaacttccataatttcatacttgtttaaatttaaaactttttctccagtaacagcctcacagaggacagtagagatttaaccttgaacatctagcattgagcctgcagaggagatgcataatcaacgtttccttctctatacctaatgcctttgctgagttaccttcatccaaaagaatgttcccattgctaactcttgtcctgatcttttcttaccactcttccactccaagaggttgtctcccatacacctctgctcccatcttaatattcttccatttcaaaatattttaatttacatgctgctatgtttatagtcaaatataattaaatcatgcctgtgggcacattctcctaaggatgctaagaattttccacatcttctattttaggactttatccaattgcttcagtgctgatcagcatgcattttggtactcatggggcataccctcatcgggattcataaacctctgaattccatgggtgagcttcagggcttccattgaaatatgaatactaaatgtgcaaatggggtctatgcatatttgtctcccaaggttaaagtccttgacctgaagttaataaccactgtccggaagtaatgaaaggcctgtggctaacatccatggacggggtcctttttctgaacactcagccctgccacctatgtttctgggcttctatgctctctctggaacacaattcctcctttctattcaagtccgagaataataactactcactcttatttatttatttagagacagaatctcaaccaggcaggagggcagtggcgcaaccttctgggcccaagcagtcctcctacctcagcctcccaagcagctgggactacaggggcacaccaccacatcctgataatttttgtattttttgtagagacagggtttcaccatgttgctcaggctggtctcgaactcctgggatcaagagatctgccctcctgggcctcccaaagtgctgggattacaggtgtgagccactgcgcccagccaactattcacttatattgagcatttactatatgtatccagcacttactatgtaaaagcctcacatacactattctagtttaatccttacaacaaccctataaaggtagtactactattctattttataagtgaggaaaatgaagtacaaggaagtttcaaaaacttccttgccaagggtctcataatttataagcagcaggccaaacattcataatttatgattcagcccaaacactctggcttgaaagtacttaacccagtgctggagttgtctctccaagctctttcactttccagaaaaaaataagactgcccttggactgtttctttgccttcacattgtaagtgatcacagattccaacgcctttaaaactccacctttgactcaatcaaaacatttccttttccgtgagttaatcatttccccttctatgtttatggactcctttgggtacttaatgcactgaacacactggtgtaattttttaattctctctccatgaattagactgtgagctcctaattattttgagtacacatggaatatttactgtgcctggaattgtgctaaggatataacaatgaacaacacagtgtccctgcctttaaataattcactcttaggccaggagtggtggcttacgcctgtaatcccagcactttgggactttgggaagccgaggtgggcagatcacaaggtcaggagtttgagaccagcctgactaacattgtgaaaccccgtctatactaaaaatacaaaattagctgggcatggtggcacacgcctgtaatcccagctactcaggaggctgagacgggagaatcacttgaacccaggagggggaggttgcggtgagccaagatcacgccactgcactccagcctaagcaacagatcgagactacatttcaaaaaaaaaaaaaagaaaagaaaagagaaaactaaacaaaagagggttatgatggtttctgaaattgtattatgaagaataaggacttatctttatttcttaaatcctgagcaaaatgctagcatgtagtacaagtcccaataatgcctatcgaatgaatgaatgaaattgggaaagggttttcagatactgaactgctaaactgaaagatctaccatcccatcatgaaactctttgaggttatttatacactgactcacctaaaaactgcttcctgtgttggtgtctatgatacattttttaatgtcagactaaaaatacacttccagtacaccaaccctgtctgcctacctaaggagtagaaatgaacacaaggtcgcatgtaacaaaagaaaagaaaattcactcatttcaacactaagctcaccctctaacaagagcatctgtcttgactgagcactatcttctagaatggttttcacttgagggtctctgaagtcatctatttacaaaaccaaaggataccaatgagattttttataaagtcagagaatcttaagtgagtcatggactctcaacttcagagagttagagtagatgggaccttaggggtcgtctagtataatttcccactcagaacaggaagcactccatagccctgtcaatagactcatggtgggatcaaggcactggagtcctaacatcatgtacactcatagcctctcgacttcccagctgggagactggcaaatcatgtaaactctgtcatcctcagtgtcctcactctgccagatataattgttccgatgatcagatgaaataaacgttgtcttaattagcgaacatttgtttgcaagtaacaggacttcacccccactaacttaaccagaaatcagctggagggatacaggagtgctttaggaaaatcaagggcagaaaatgctgagaagctggagggtctgaaaccaggaatagaaagctgtcaggaggaaagtcaactcttatagtctattgtaattacactaatagtcttcatctccatttcctctttgcatctggtcttcccactctgccagtcaacaatcacggcttctctgtgcacgtgtagaatgatgactgcccaggtggctctcatggcttttcagtttaagtgctaataaaggtagatctcgaattactgaaacacaatttcttataagagagaatttgattgcttcccctttggccaagggaccactgctagtctgatcagttatggcttggggactgatcatatggccagttgcccattcagtagaggtggtggaacatgctgagggagggggaagttaaggccaagttcaggccaagcaaatgactgacaacaaagacaagcaacagcatctctagtgcgatggtactttgcaaagaaagcactgccccatgccagctatcactgtggccatccttatgatcctcaccaaccatcttctgcttgaccactaccagtaacaggctgctcactactggtagaggcaaccttttcatcagcaaacaacttcagctattagaactcttttccatgtgacagcaacttaagatactaaactgaaatatttgtaatcttctcccaagccttaactttaatgaaggcataatcttgcttgttaggtcaagcctgggcttttctttctagtcaaaatatgaataatgggcaaagcaagatgttgaggaaaagctgagtgttgggagggaaactgaggcagggcttgcataatgtctttgggaatgtgtctagacttgctggttccttacttctagccctcataggctcctaggctcctattcccattatctcaagtagcagaacatgttccatataaatgctaaaccatcacagctgtagatcatgtgcctgctcttttgacctccacattttcaccacctgtttctttgttggattaccaataaatagcatgggctcccagagctcagggccttcacagcctctgtacactagtgatggccccctggtgtcccaactttctctctcaaactgtctttttctcaatcctttgactctgctggactttgtcacccccacaacctggtgttgggtctgatcaccccaacacaagagagatagattcactatgcaattattttagcaaacaacctggaccagaacaaagccagaacctcttcttcctataaagaattactactatctctctactaacaccattactaatgactcactaaagcaaaagaggatctggaactgtttctagcatcagtgtgtagacaataggtagggttggggaaaatggttttttccaatgtagagtccctagcacttttgcaagcagaattctgccttgctctcatttaacttccttttgcttagaaaaatataatccagaaaataatcttaacttcatttttttaagttaaccaagataaagttgtgaattccccataaaagaacctcataatagctatgttatgaccagctggcatttaaatactgaaagacccaaagttagaagaggaggtgaaaacaaaaaaataccttctatacattgggggcaccattaagggatgtgctgcttctggcttctctgctcttcacattagtcaatgatgtcaccaggtttttattttagtaatcaggatatacttgtatggatgcaaagagaatatcctcatttatattctaaactcagagcaggaaatgagacacgtgggtgatctgcagctgtggcactataaacagggccagcctaccacctagtctagattctagactgcacttcattccctgaaatactgattgggagattttaaaaaattgaaaatatatcattttagaaagaccagtgcatcttctgtgcaaggatcttagagtccgctgtttggtagaaggctgactcacctgtatggggtggtgcacgtgttgttaggtaccatctacctatctacaccactgatgtacaacgaggagatcctgccctggctccagccagctgtgccaccgtgggcgagtaccacagagttcaagctttctccagctgctaaattaaaggattagtgctttaacttgggtcaaccacccatttgcaaacctgacaagaaccacaaacactcttacttcaaaaatgcatataagcaaataccactgaaattttatgtagagtatcaaggggttctcttagcccttacactccagtctaaactgcttggttgatgattgttagaccagcagccctctagtattcctttcagcactccaagctaaaataaaacagctgatgtttagtaacaatttctgcaaattattcaacaccatagaagagtgttttgttaagactagagactaatctaacacaatctactcaacaatgttaaattgaccagtaaccaatagatgactagaagaaagtgtatgtaactagatataccaaactatagatactaattttaaaatcttggaaaggttttggaggagccctactgtttctgaattggaatttttcatttgcaaatacttaacaaaacccaccaagccagatagagctctatagcgatgcctatggaggagccttataatgatgttgtccaagtaatgtgcttaacaataatcacactcaaagccaaaggttcccatgctcctgccaatataacatgctcacaacggtcaattccaaaggaagagctgtcaagaagtgcctgaagatttcctcaaagggagagataattcatgagcaaacaaacatcatgtccctaatcttctctatcctggggtaaacaaaatatagttttctcccatgatttcagttgctttctataccaagtcagtaagtaaaactgattcatactggtaacttccaggttccagccttggtttgaaggggcacacaattcaataagagtaaagaagactggccatgtaagcccatcttgaatactgacaacttccgtaccatttacctaacactacaaaccctactccatttaagtctctgagatctttttgatgtattttgagcttttcaacttgccttttttggtgggagaggagggaggaggagaacaaagggagaatttgaagtttttatttctgcttgcattgactcaaattgtggtaaagaaacttaaaaggtaactttaaaattctagtgacactagccaacaatgaaaactatctaattagaatgttagaggttttttttgtttgagacagagttgctctgttgcccaggctggagtgcagtggtgcgatctcggcttgctgcaacctccacctcccaggttcaagtgattctcctgcctcagcctcccaagtagctgggattacaggcacacgccaccatgctgggctaatttttgtatagacagggtttcaccatattggtcaggctggtcttgaactcctgacctcaggtgatccacccacctcagcctcccaatgtgctgggattacaggtgtgaaccactgtgcccagccaaaatgttagatagttttaacacaggctataacatagtcataaattaaagaagacatggtcgtaaatgaaagaagacctctttttggtgggagtagtagtaggggtgggagagtagagttatacatttcttcttagcagttgcttcaacatattttattaataaggactatctgctgaagcacagaaatacaattatgtgaatatcatactaccaatggcctgttccatcatagcagggatagttcttatagtgtataaaatcctctgccccattcagctctctttatggagctttcctcagaagcatcagaaaacacagaattaaatatcacaattcttgttgaaggccaaaaattagttcccagaaggattctttgactttcatccttctacaaattcacccatcaccattgtagataatgtgaggggtgaatttgtagaaggatgaaattcagagaattgtttatgatcaatagattgttccctttattccagttgtcttcccttgatgtccacttaacattccataataaatggacaaatggaaaagcacaattactctgccaaaagtcagtcaacattctcccaggacactcagccatctaacttgaaaactgactggtaataatatcattctaattactttaactagaaatttgttatacagaaatgctttcagtgtggggaaagaaaaatcacttgccacttatagaaagaattctgcttcatgtgaccatttgcaataatgaaacaagtaagacaacactgggttccagtgtacagcacaaggatcaaggcgaaacataatgctttcattacgtaagaataggactgacattattctggctttcccctacccttcatcatttaccaatattttttcagtctcaggaatttttcaacccctgaaactcctagatttactactcaagacacagctatccatcttgaggctttctgccaatggctctagtgcttctatttcaacagcttatagatttgaaagctggaaagagagatatgtaaacaaattctctaactttgatctatgcacccaggtttctcaaaagaagcccttggagagtctggggtatactaagtgtatgacttgcagttgtaatcattagagtgacaacccatttccagtgggtaccgttttagccaacccaaacctttcttttcctaatgcatagagtgactttttaaaaaatggtatatttgggaaagtattttagaatggcatgttaacaaaacaaaaacactctagaatatattttcaaataacagaacttggccttaccaagaggtctaataccatcaggtaaataatcatttttatcagtgattcataatacatccagactctaaatgttaaggctgacttttttctgacactcttctctgcctattcatactccatttcctaactcctttagagtaaaaattgaaatcccatatccctaacaactagacagaagcatcatgtttacatcctgacaaattcattaattctgtacctctgaaatatttagcaaaaagccagcactgactcaatcatagatttccacagacaggtctgttcatatttgtaattggtattcactgaaaggtcaatgactcctgttcccaagtatctatgagtctctagattttcttaattggcctcttttcctcagctcttacagactattgttttaaaactaccaccatttagaagttgaactccgagtgaggggaaaaacaaacaaacaagcaaacaaaaaaaacactttttgattcccactccactcataatcaacataacacagactacttctgacccaggtgtgatggaaggagcggggcacagagtcgggggaggtttctccacacaccaagcaagcaatcaatcacttccacagcagacatcagctgggtgtccaaaaattcaattttgacaccacttacctggaaatagcatcaagtctcataggttgaaagctcagtcccataagactgctccccacttcagatgcccatcgaaaaaacaggttgtggcctgttataaatacgcgttcccatgaccctcctccttaggattgattgatttgctacagaggctcacagaactcagggaaacacttaacttatgcacgttataaaggatatgacaaaggatacacatgaacaaccagataaaagattgatagggtaaggcatgtggtatggcagggatccctgaccctctggcagcagacaggtaccagtcagtggcctgttaggaactgagccatatagtagggggtaagaggtgggtgagcaagtattatagcctgagttctgcctcctgtcagatcagctggcattatattctcataggagtgggaaccctattgtgaagtattcatgcaagggatctaggctgcatgctccttatgagaatctaatgcctgatgatctgaagcggaaccatttcatacccaaaccatcccccatcccctcatctgtggaaaaagtgtcttccatgaaaccggtccctggtgcccaaaaagttgaggatggctatgataaggcacagagcatccctgtcctctctagggtgccatgctccgggaacctctgcaagttcagctgtctggaagctcccagaacccagtccttttgagtttttatggaggcttcattacctaggcatgactgattacattattggccataagcgagtgactcaatctttaggcctcttccctcctggctgttggtgggtggggctgaaattagttccccacccttctaatcatgccttggtctttcaggtgaccattctgaagctatctgggagtccccagccatcagttgactcattagcatgcaaagaggcattcctatcactcaggagattccaagaattttagaagctgtgtatcaggaaatttattactataaagtaccttataatgccatcatttttctcccaaaggcactggcttgattaaattcagaaattaaaacaatggccagcttctatagtgtaagtcaatgcttttctagttttctgagggtttggaaactcaaatcctagctaaaacctgtatcacttttaaattgaaaaatttaaagggaataaacatttaaccccaagtgactagaagtcatttaaaatatgtagtacttagattattttatctactcaaagactcttcaaaagtagatgaaaacactaaccagatatatattataaacccaagctttaatttcagagcccaaacatgaaatctcttctcattgtttgaaatctgaaactcatttcaaagactgccacgaaaagttaaaaaaaaaaaaatggattggtcttgacttttccttacatatgaagtaatattgttacaggtgaatctctgataagcaggaagccatcatgtgtaataggatcttgtttgccacactcccaaactcttctctgaagtcctgttcattgctgtcagaaaggaatccaaagtaatgataaacaatataaaaagtagagagtctcatgcattcttaataccaaaatcagagagaaatctagacctgatgtgcctgttatactaaaacatgtgtgtatatgtatattgctgaatatatataacataatatatataatctgtataatcaatgccttgctcagtgtccataagcaaaggtagagaggataaatttaaggaaatgaatattcccacaaacacaacatgtaacttctcatataatagttagcagctggccaggcatggtagctcacgcctgtaatccccgcattttgggaggccgaggcgggcggatcacaaggtcaggagatcgagaccatcctggctaacacggtgaaacctcatctctactaaaaatacaaaaaaattagccgggcgtggtggcaggcgcctgtagtcccagctgctaggggaggctgaggcaggagaatggcatgaacccgggatcgtgccactgcactccagcctgggggacagagcaagactccatctccaaaaaaaaaaaaaaaaaaaaaattagcagccaaaatgtgttgctgctactcatgaaaagtattttttggtgtggttttcttgatagctctattaagaaagttattttatacatttatcaaatgaataattagtggtccatcttgttaactttttagtatgccccctattaagtgctagttctcatgttataagaaaattaaggattatttttaagtcagaaagcttgagtacagtatttttgtagatgaagataaaatattttaaagcatgaagatgtacatgagaaaaaaataagacattaatatttatatatagaaatgttttaaagctttgccaacatgggcatttttgttgtttaggattagtatttgctgggaagtaattcatctgtgaaattatttaacatgtagaattatttcttagtttctggtttgggagaaatgctcaagagttgagcttaaaatcattttattcacactgctaaagctgaaaaatgtaaacagggagctttcaatacatttcaaatgagtttggagaattctaaaatattcaatccatttataatgaatacaaaacatcattagaaactggcaaaaaaaaaagtagctaaaagtattcgagttatttcacattactgggaaagtttcttttaaaaagttcagttataaataacattcactaaacatatttatccttttttcaattttggtggtataattttagaaatttatcgttgacttttaaaatttcacctaaacttacctgaggctctgcattatgttactcaatgattctgatgccaagttttgaaatcaaattataggccagtcaccttcagtgatgtaaaaggtagaaccacaagataatccagcactttcctcacaacctgaaaacggaacctgtggcaagtacctgcccaagtgtcagactatgctctaaacaactgcctgtcatgtaacaggctgctcgaaagcagcaacatactactcctatagtcaattcttaacttcttaaccacaatttcatcagtgtaaaaaatataggagcagtggggaccagacttacatatactgaaatgttaaacaacagaactcttattttgaagtgtgggaggggaggaagcacctcaatcagttgctttatgttccttttagtggcagaagaatgatacaatccagtattttcatccacagctccctaaacacaaagctgtggatttcataaatgtaaatatactgcgtaatctgcccactgggagttcatagtttagtaaggactcagagaagacaatttcactgtgcagaacacaaggctgataaagtaaacatcacaaggccagtaatgaagaatgcgtaaggaaagacagattatatccaggaaggaatgaggacgggagataatatagaaaatacctaggaaggctccaggggaatgtaaaatttgggatgttgtgaagaatgagtaggtttatctgggaggagcccttcatttgtgagaagaggaatcacaagagaggaagaggcaggcaggatcaatatcagcgaagacgcaaagggagaaactctctggatgtgtttacagggcaggaaactactccttttgaggatgcagagaatggttactggccagcagtgaggaaggaggctagaaagaagccttgagccaggaagcgagaggactctgaacaccgagtcttatttgttagtcactgaagatgttttgagcaaggaaatgataaattaaagctaaaagagtctcctccttatcagaggtttcaccttcagtggtttcagttagcagaggtcaatcacagtgtaaaaatattagatgaaaaattccagaaataattcttaagttataaattgtgcactgttctgagtagcatcatgaaatcttgtgctgtcccctgataagaatcacccctctgtccagcatctccctgctcctgcctgttagtcacttagcagccatctaggttactagatcaactgctatgtattacagtacttgtgtgcaagtcatccttattttctctcattgccccaaggtgcaagagtagggatgctggcatttcagatgtgctaaagagataagtcaagtgcttcctttaagaagatgaaagttctcaacttaaaagaaaaaaaaatcttatgctgaggttgctaagatctacaataagaatgaatcttctgtccttaaaattgtgaacagtatattttttctttcattattaattattgttgttatcttttactgcacctaatttataatttaaactttattctaagtatgtatatatgtataggaagacacatcatgtatgtatatagggttcagtaccgtgattttaggcactgggtggtcttagaacatatcccctgtggataaggaagacttacctctaccacgtgcttcttttataaagactaatctcactaaccaaggtgtagaagtaagaattggaaaaatggctgaatttcagcaataaggataaatataattggataattgtaatagctacttttaatttttaactgttttaatagtacttactatgtccaggctgggtgcagtggctcacacctgtaatcccagcactttgggaggccgaggtgggtggatcacctaaggtcaggagttcgagaccagtctggccaacatggcgaaaccccgtctctactaaaaatacaaaaatttagtcccagctactcaggaggctgaggcaggagaatctcttgaacccaggaggcagagattgccgtgaaccaagatcatgccaccgtactccagcctgggtgacagagcgagactccgtctcaaaaaaaataaataaaaaataagtacttactatgtcctaaaagttttacataaactaatttattccttagagtgagttggttaattaggcattattatccatattttacaagggaggaaactggctaagagcggttctgtaacttccccaatactgcagagcttttaaaaagtggcacaaggatttaaacccattgctgtaggactcctaagtccatgctcttaaaaaactttctatcttaccccctaatctagatataaatcagggatcacatttcaaatgaaactgtgactccattgaaaagtatgccagcaggtagtcagcctctaagatggtccttaatgatccccatctcctggcattcatgctcttctgtaatcacctcccttgagtgtgggttgaacttactagttcacttctaaccaacagaatacagcagaagtgatggaatgtcgtttgcaagattcagcggtttccctctccagcactgctcaggctctctcttggctcactatccctgggggaagcccgctgccatgttgcgaggcagtcttatggagagacccatgtgggagggatggaagcctgccaacaaccatgtgagagagcttggaagcagatcccccttccccggtggagccctcatgcctgatgagactgcagaccaggccaacagcttaattgcaaccttgagagagtttgagccagagactcccaaactagattcttgacccacagaaatgaggagctaagaaatgtttataggtggccaggcacggtggctcacgcctgtaatcccagcactttgggaggccgaagtgagtggatcacctgaggtcgggagttctagaccatcctggccaacatggagaaaccccgtctctactaaaaatacaaaaattagccaggcgtggtggcacatgcctataatcccagctactcgggaggctgaggcaggagaatctcttgatcacgggaggtggaggttgtggtgagccaagatcgtaccattgcactccagcctgggcaacaagggtgaaactcagactcaaaaaaaaaaaaaaaaaatgtttatagttgaaagctcctaacttttagggtaatttgttacccagcattattaatacagtcagtagacagtaattatttattattacagggtaaatctttttctttatacttggagctagaagtagggatctgtctaggagagattatacctgaaataaccacaaccagcccaaataacagaataccacgtcctttacctttccacccaaacatacataaatcaggtaatctacctatctcatcctcccatggctcttcttgttgtccttattctcctttgcttgaatgcattcttaggaatagaaatgctaaaacccaaacctgcaggtttcaaaaaaaaatttttagacatacagttttgaatctcatagcaaactctttccttcccaaggctcctcacattacattgtgtattcttattatagcacataacatgttttttcttatttgtaggtttaagtgtctgttttccaggcaccctcttccctaacccgttacaagaatcatgtctcgtgtgatcttatatccccagtactgagtgttcgtatggctgggacttaataaagtttaaatgaactcatgaataaatgtgttgcacaaccaatgagtgagtgagtgaacaagtgagtcaataagcaagagtttagggacatgggaaccaccacttaaaagcttgaggctgttgtgcaaatttggaccttcatataagccatttccttctatatagaatgctctttcttttgctcatcctcacctcctcaccaggcttttctctctttaacattcacctcaaagagctgtctgattgcctctctacaactctccccgccaacacacacccacacaccctaccagggaagtcttccttttctctgctgtgaagccttttctttaagtttccatatcctcctgggcataacttggtcacagcacccagcataccacactgtaatgattagttatttgcctgtcatttccacttagccgtaagttccttaaaggacagcatattcagctaacagcagaatgcctagcagtggtaggcactcaaaaacagtttaaaataatgggcaagagaatgaatgaatgagaaaaagaaaactgtatctagaaaattatctcagcacaatctatttatttcaggtaagctatcagtcaggtatacatagtgctccaactcctaaacagagtaaaaataattgtacatcaagattattacagatacatgaaaatcatatttagaaatagtacttcagatcaggcatggtggctcacagctgtaaaccaaaaatttggggaggctaaagtgggaagattgcttgagctcaggagagacccccataaaattttaaaatttaaggccaggtgcagtggctcatgccagctactcaagaggctgaggtgggaagatcgcttgagcctgggaggttgaggctgcagtgagctgtgatgacaccactgcactccagcccaggcaaaagagaaagaacctgtcacacacacaaaaaaaaaagaataaaaaattacaaaattagcgtgcctgtagtcctagctattcatgaggctgaggtgggaggatagcttgaacccaggagttcgaggatgcagtgagctatgattatgctactgaactccagcctgggccagcattcgagatcagcctggggaacataggagactctgtctcttaaaaaaaaaaaaaaaaaaacagaagaagaaagaaatagttttcaggccaggcacagtggctcacacctgtaatcccagcactttgggaggccaaggtgggtggatcacctgagatcaggagttcaagagcagcctggccaacatggtaaaaccccatctccactaaaaatacaaaaaaaaaaaaaaaaaattttgctgggcgtggtggtgggtgcctgtaatcccagctacgtgggaggctgaggcaggagaatcacttgaacgcgggaggcggagattgcagtaagccgagattgagccactgcactccagcctgggcaacaagagcgaaactctgtttcaaaaaaaaaagaaaagaaaagaaaagaaaaagaaataatgtttcaatctatggacaggccctagacagagctgcctttaacacatctttttccctttccctcacatccttgatcccatctcagtcaaaaaggaaaaaacaaaaagttttcttacttctcagcctaagattcctgatactgtccccagatgccatacatgtattggcctcccagaaatcacccagtgattttctccccatgaaaagtttatatgtctcatgccctcagagtttttaactgcaaataagctaaaaaaaaaaaaaaaaaaaaaaaaaaaaaaaaaaaaaaaaaaaacgaaaaaaaaacctggtttggtggggaaatgggtgctcatgggttggcatttccattttggtaggcatctttttctaaggccatagctttactcaaagcccagtggaaaaagacatttaaaaaaaaataaaaacctttcaggaaccctcaagtcactccattggggtgaactcccctgtgacactagagaggtggtgaagcttggtggttagggcagttttctgagtcagaaatctcagcttttccactctctagtcttcagatcatgagtaacctcactggtgcccaagtgttccatctgtaaaatgaaataataagactacctcaaggaacctggtgggaagattaaatgggttaatacaggtaaagtacacagaaagtgcctgggaagtagtcaataattgtttgctattactattaccatttttacttttattagaattggctcaaaaagaacccaaagagggcaatgctcaaagggaagaaagggatgagaggagagtacacttaactgatttggttgtttagcttgaaggcaatgtccagctgcaggataaacagcatgaattggaaccaaggactcatctccatgtgggggaggggaatgtgaacagaaaacacgatgtcattggcttcaatttcccttggaattgcctcttcaatgtctcggatcttgtcacaatgattgggtccccaaggcacgaaccattttgtcttgtgatggttcttacgggcatccacacatttcaccgacatgtaggacactgccgttgtgggccctggagctgaaaagagaaagtttgtctgttttagaaaagccatctattgaaactactgtttctggttaatattctttccactgctgtgttccctccagcttttgtatcgccttctacaagtggggctcagcaatacttagggatcttccaaatctgggtgaggatctttcactgacctccagaggtgtcataacagtatctctgagaaccttcccattatgttttcaattgctgtgaaagaatacatttgtaaccagtctagttatacttccccacttcaaaacaatgtcacaaaaaatcaactgtgctacagttcccacctgattgaggtcttggagagctctggtgcttcatagagaacagtatctaaagtcagaagaccttagtcttcaaacctggattcgaagcctggttaaaaacctactgtcagtgaatcttgggtaagtcagttaaatctgtaatagcttcaggaccctcatctgagaaacggaagagtttctaagattccttttggctctaaaattgtacaacattgcttttgcttaagataaagaactaggggacaccagttagcttggtacctagcagagaatgggaactcaaacactgactgatacttcaaaagtgtactaaaatataaacgatgcacttcaagacagcaaagcaactttgaaatgtgtaactttaaaaacactattttgtgattatataatggttatatgattataatattaataacttggaaaatacagaaattttaagttcaaaacaacatttacccaaaatcccactagagggaagtaaccactgttggaaaatgtcaaaatgccatctgtcttttctatgactgtgtaattagataaaaagtttacacatgaattaaattgtgtaactttaaaatatacgcaaatattaacacatatttataaaatagttatatcatgcatagttttgtagtcttttctttttattcacttagaaaagcagagtattgtgtgataacaccagctctggaggcgacctgtctggtgtcaaatcctggctctctcatttttagttgtgtcaccacaaatccacactaggaaagttttgggcaaattactaagcctatctctgtatcggttttatcatctcttagatggcaataataatagtactgatctttccaagtcactgcatattttaaacaagttaacatatgaaagcactcagagtagtgcttgggcacacacaaagtataaaatattagccattatatcatattttctttataattaaaatctttcagttagtagttgcaaaatagtcaatcacacaatacaccaaaatcaacttctccttcatcagtttgtaaaggctatctataagaataatcctttgcctaatatgttttgttggaaatttctcctaaactttccatctgctatctaaatttgtttatgcacatttaaatagagaagttccagatcttatatggaatccctcttttatgtttttccccccatgcttttgtgtttagagaaactgaccttcttcatctcaaaattcaatagtcatctatattgacttctatttattttttgcaatttcattttttctaatatttaaacagttgatccatctgaaaattgctataagagatgcagtgaggttctagttttatttcttaaatatttaaattatagttgattgaacagaccctcccttttgttgatttatcatatcactgttaatctttatgtatgtaagcatgtttctgaacatctgttcttttccatgcattaaactgtcaattcacgggtcagcacaacattgctttgaattttataaatttattatttttatcaatatctgctagagtaactctcttccccaatccatttcaaatttacatctttttgctaggatattgaagattaaattaaatttataaataataaatatataataataaattaatgtggacagaattagcatccttccccagcgtttagttttcccatccaagaacagtacttgtttctccattgtctacaatctgtttttaaatttcttggaaaactttcattgttttctttatgtgggtcctactagtatattttaaaatagatacatctataaacctttgaaagttagtagttaaaagaaagtgtcatcaattatggtttatgtgtgtggtttaaatatgtgtatttctgtgcatctgatacttggtatattatgtttgcagaaattctctcttatttaatagagatcagatagcaatggagaaacatgaaaagcaaaaagaaagttatataacgggaaaaatgtgtattattaatattctgccctacttctaatgttcgaatccacattatttttctattctattaaacatctattttaatgatacatttttagtaaaatgttatgtttgtaagaagttaggacaatgcctattaatacttaccagaaaactcaacactactaagctctagctgaacatccttcatgtagaaggctgaacactgcaatacaagttgccactaacccctgctacagacgtttttctttaaaactcaaaactgtatcacgaagacctcacatctaatccatctaaaatcagacatctgacttattcttagaaatatgagtcaatcaaactttggttatcctgactcagctaaatagcccactgacattagaaaagccaaatggcacatttaactgaaccctttttaatgtggttggagaaataaacagtgagacaaaagtcatgaattctattttcggctaacatactcaaactgactatttgctgcagaaaatagttactacattttaaaacttctattcttccaaaatgaacctaacctttttttctttattttttaccttcttgaaaaacaagtctctcacttctcaggccaaaacgaaaaataactagctgagttcctcagctaagctccaaaaccacattccaaacttaataacagagaagctgaacactttatggtcacaaagtccgcatttttaatgaatgcagtgaacgcctgcctttttaggggcctgcattattttcatcctctcattagtctagtgtttcttctataaagaaaaaaaatcccagaaatactaatattttcataaatatcatggcagtgaacttggagaagcctcaagtgcatctcaagctatactgtgagaatcacaatttttttcacttgaataaattagtccttgagtctcaaaaatgctttccataacttcaaaacctgaagataattcaacattttccgtttttctaatagtgttcaaaagagaaaacacaagtattgcttgagaaagtaaacagacatcctgatattcaaacatggacagttaatgttcccccaataatatatttacagctcagtgcaatgtcctactccagctaaaagtgaattcccaagtgtttctttatatagacagcattatcacgtaaaccaaaagcaaagcttacagctggtagctggtcacctaccatagaatgtgttttcattagctatagtcaaaattttagctacatgggtcacaaattgtgtctagaatcaaaaaaagtttgatctgtctgtaaatttttttaaagtgtgtgggattaagagaaaagagctaaatggaggaagtttaaatcatcttcaacctttgaacaagccacaataacaggtatttgtaatgaaggccttacttagtcacttgcgtggttctagggattaatagagtttgtgtattcaagagggggctggatagattcaggtcaacaaactgagtcatgtttgctcaggtgaaagctaaaaataaccactccccagtattcctaggagagtaatgcaatattacccagctgcctcagcacacattataaatgtctcctccacccacccatagtataaggtttaactgaaaacaagtaggccaaaaactacttctacaccagaccaattcaatgacagaataatttggccaaaactaaatatgcctagtcactgtaaactggttaactcatggttggttaagatagccttgggaatatgcacagaagttataaaaccatgagctattcattgaaaatgcagtccattatgaattcagttctttttactttatcaaacatgaccattttattttgtctgtatttcaatacagtatttttggcctccacttttccactacagcacatgaattgtgaaatgtgattctatataacatttaatgttaaagtgatatgaaatcaataagacttctaacaaattcaaggtgtgaagaaatgtacaaacacaacctgaagtctctatgaaaattcagtggtccctcagttacacacattactatggctcacagtatattgtccaaatttgtcttgagtatctaccatgcactagacactgccggttctggagtaaacctgataggcaccaaccatatggaacgtacaaataacggaggaagcagacaataaataaacaatttcaggaaaaaataattttgatgaatgttatatgtaacctgacattccctgagaaagggcaacagtcagatatttgggaggtgggagaaatgaatacaccagaatgacagaaaaatccagtcatcgttacaacataaccttgaataaaaatgtaagtgaacaatgactaaacctgtagtacttcttttggaagaatattcattgactccagtcagcttcctgttatttcacttcaaatggctatccagtttacaaattactatctagccaaccgctagcatttatcatgcttaaaattgagtcaacattaaatcattagcccctattccttccagaacctgtaatttaagagttagagagagacaagacttggttgcctcttagaaaagttaaaataaaactaaaacaacaggctgacatgacacattgtctccatttaagccaacatagactatttatttctttgctttattatgagtaatgaacatttctttagcaatcacctaggagcattactattatgcaggtaccgtactaactaaagacagagacgaatggcctcccagacccccatttgctcacaggctagtgtgggaggctgagaagttcacaaagaattacaccctgattggaaatttctttgacagaggtttgcacaggatgctccagttgtaaaaagagctgagggtagctttcggcagggcttagccttggaagagagcaggtaatagccaagggagaatgggggatggccaaggagggaaggtgctgaggtagagatagaacatgtgctgggtcatagaatatctaaaacaatcatattttctgcagatatctgtgcttgaatattaaaaattaaaaagagatcatttaacggtgaaaactgtagtactactcttatctctgtgtccacccttgccttttctaatcagtggtataattctactagagtgccttggcctctgctcccaatcatccctgctgtactctatagagcaccataaagaaggaataataaacagagccacacataacaaagaacttttatttggcaggaatgtttccttttatgacacctatctctgccctgtaagtagccacaaggccagaccagagatctgctggaaggaggcggagtgagagggtagtcaggtgggaatgaagaagctccccgtcctattcccacaaatggccccaaagagcctttgaagtctcagtcatcaggtaataatagccttcctctaaattagaggaagaatgtctgccttgcaacaaagatgatatttaaagaataatctgctttggggtacaaggggaaggaatgcagagaatagaccagttgaaaaggtaattcctgtttataagaattaataatcagaacagcaccattttaaaaagtaatgacttaaagtaaaaatggtcaaagatttcagaaatgttttagagaattttatgtttacaatagaatttatctaacaaaaatgataggaacaatacacattgatttaaaaacatacaaaaagttggtagcagatactttctcctactgacttgagacattgatttaacacctgaaaactaatctcagttaaaaagctgccagcaccatctctccacctgtaaaaatgtgaatatttatttatattttataatttcattttatttattctctatcttgttccataaaacattttggggtactagaactggttattagcctttattttttaaaaataattgggactgatttcaacggatagaattaatgttggggcgggggtgggcagagactacaaattacttggtctatgtctatatcttcaaaagtttggggagcttatattctccagctattgctttttttttttttttccagctattgcttttgaaacaacagctgggaaatataagctcctcaaacttttgaagcaatagctgaagaatgaatataagctcccaaaacttttacctgatctatgaagttgaatggctcaatatccattttactttgaaatgtagagaaaacctccattgcactatgaatggtatttataagaactaaaaggcatatgcccaagttggttctaagctctgcctatctaaatatctctgcttgccttatgagaacttatataaaacatattgagcacttaaacccttgggcaattgcagagtgtgctttggattttttgagtatcaaggtggggagggtcgaaaagagggagaaagggaacacaggtgtcagaaaagactagatgaattcctgttatgtaactactttttcaaatgcccccaaagtacttatttaacctaagaaaatctttagctaagtttagaaattagctttaaatatgctcaattgattttccttagacattccacatgcctttcgccagctcaaaagccttaattctggttaaaaggaaacatgtgaaatatactgcacaacttcagtggccagatcatattaactggctgagctgtgaggtcttatgagccaaacctgcttaccattcactgaaagtcagttcctaaaaagatttcttaatatctgccataccacttatctaagttttgggtggctaattagaatgagctcttcaaaaagttcagctaaagaaagtgcaaatatttgcattaaattgacttagtacttaaatgattcagtgtgttaattcttttactgaaattgctctgaagttatagtagacacttatgctttctccaccacctactttgaagagaagattctcctatatttcaaccatacccattaaatcttactagcttactaaatgaagtattatttcacaattcaatctcaattactggagagctgaaagtgtgtctacagagactagaccagaagtgatttttacaattatcaaagctatgcccttgtgcatgaaatggggtacgctaagtgaaatgaaattcattcttgccagccactttcagtcagttagttatgctaacatctgttctaggaaagctaattttttttaatacagcagaacattcctttacactgaaccactaccaccaaaacacaaacatacatactacatagcagagttgaatgcaaaataatttgtaccgtacacacaaaagtcaagcacttatttaaaaatagttctttacaatataaacttatgaaattatggacattttgacagcaattttccaaaaattgtagcaaacacttgtaaatacattccgactcaaaaatattgaaaatatcatatgtttacattttaggcagatgaggattttaaatgcttcgcctacaacctcaattgttgtggagccaaagatgcaacagctttgaagaatagaagaattactctatatttgtcaggatctacgtggcaaacaagcgccacttggcttacattacttgcctggcttggatcccatggaatggaggagcattggaaccaagaggaaaaaaattaaagtgctttgggacagcgagccaaactcttacatagtatttgaaatggtgtggcaaacatgaaattattttaggctcaagattggtgctagttttttaccctctttttgaaaaaatagtaaaatgcacataaagggccctgccagaggtttagctcataaaatctgccaatcattggatgtgctaattggtgtagcaatccagtggtggcctggattaggactcaaaaactgacccttaccacccttggtgtcctgcagcaaagacagcctaaatcgaaaagactgatggaagtatatcaaattacgaatttctctatccctgaaaaatgcctgcaatttctgtttctccatcactccagaaatactcaaaacagcaaaaattaaatacatatgaagtgaacacaaaagacctccacagaaaaatcagtggctcatctgttgacgctattgctcattgctcggctggccagtcatctgggctaagttttgactttgggccagtgcttcaaaatcagcaacctttcagccaaaagactgtggaatgcagccaagaccacctgtggaaagtgaattatagcatctttaatttactaccttgggctatgatgtcagaaacccagcatggagggcgcaccagttcttgtgtgggaaatctctcagagcccccatggaggcccccaaagtggctctggcaaagctgtaggggtggaggtaacaaaaaaggggacacctggctctccttcttaaatcagctcaccatgggcacacatttatattggaattttagggtcagaaaataccaaaattaaatcttctagaagaaacacagtcagtggctttgctctaaagtgcctattacactctacaagtttccaacatttgttatttaaaataatcagacatttattattcataaattacatatattcttttatcaatattattgttaataataaacatgaacaactagtaagtgaattgcaaagaactttcacatacatagattatcgaatccacctagttaacaagtaacataattagcaccattgcatattcagaagatcagtggtttttgtctcatcagtaaatagagttaggactggaacccaggtctgatttcatatctaatgctcctttccaatacaactatctgtttatttattaacggttactatttattagcactctcagattacctgagatagttgcagagctgagggatgaatgaagacgactgtggccataagtagcttgctgaagctccacaggcaaggcactaccagcactgggctgggtgtcactcaaagggagccagcaagatagcttttctgggagacttacagtcagggacagagtacctctaagacttccataaagaaatgatggagtaataggctcatgaaaatgcactaaactcccttgaatctgataccctcccagtttttaccgggtcttggttatgacttcatattgcaggtaggcagtgtttaggatgttagcctagagaagatctgactcaggaacacagcgctgccatggaagtctatgacagcacttgcaggcatagtgagagacaggaattcaagttagagaaaatctgactccagagcaacctatggaagaattacttataattcaggtaggcaaacaatggcacagtttgactcaggaaagggtgggttcctcaaccatggaaacatttgggaagtaaatggatagataagagcaagagcctgaactaaatataagttcctctcagtcacaccaaaataagtctcctatccatgcatatggtatgtcagggaatggagaaattaaggtccaacaaagagctgcatatagtttattgatttgttttctattttctgaccagttccagataaacagataaaagcaattaaagtacagggcattctgaatggtcaaaaatttagtattgtacattgtaagttaaggctaagggcaagtaagacctgttaatgtctttatctggaatttcacaaatgccaagaataatcatatttccttccttgattgattattcaaagaaaacacaggcccttataatttgcaaatttcctagaattgagggtagaggtacattttaagggtaacttgcagttttaacattcacattcttaggaattattattattattaatttttttttttagacggagtctcgctctgtcgtccaggctggagtgcagtggcgcggtctcggctcactgcaagctccgcctcccgggttcacgccattgtcctgcctcagcctccagagtagctgggaccacaggcgcccggctaattttttgtatttttagtagagacggggcttcaccgtattagccaggatggtctccatctcctgacctggtgatccgcccgcctgggcctcccaaagtgctgggattacaggcttgagccaccgcgcccggccggaaatatttttttaaaaaacattgaaatcacaaaattaaatagtctatgcaattatttagtattttaaatttcatcagttttaggttctagctcaagggccgtctctccttcattcaatttgttaaatgcctatagtgtgccagctggaggcctcctctgattttccttcagttgacaaaagatccttacttcctttggtgccagtatcacctggtctatgtctttattatagcattctactttatttgcaggcatcacttctgaaccctacaaaattataagctcctaaggggaaggactacatcttattctgccttgtgccactaagcacagaaacttaaacatgcaagtcctccagacctgaactgaactatttattatatggcttttgtgtcataataaacatattaatgtaagttatgctcaatgtaactaacaaaattttatcaaatgcctactaagcatcattttttaaatgccatagtggattaatccttgtcccgcctgtatcaaagtacacttagactggcactcagtgacagtttgggaagaagccagagctgccttccgtgaggtcagtctcccaaggtcacacatgtgctcatcagagactcacttcctacaaatacttatgacggttcttccagatccgtgtcaagcaatatattaaatgaaatactgaattttgaagatcaaaatgaacttttcctaaactataacccaatccacacaagtaatttacacatcaaaagaaattagatagtaggcaaacaaaacaatggtaatttttttaaaaaaaactgctcccaaagggtttgtggccaacattaatattgcaggaacatgtttagataactgctgttcagcatagttcctggaaacaggttctcaaagccaggacttacagttatttaccttcttccagcactgccctgagggttttaaggcctaaatgaatagaaagcaaatgggggacaaaatgaaataaaatgttcacatctcagcctttagtgtatataactaatgtttgaagattttatgacaaaatgtgtcttcttaagaacacatgtagggaagattttggccatttctttaacaccctttaaacagtacctaccagagaaaaagcaaacactcccttctaaaagcatcaatattctacttctgagatcaaaactacaaaacaggctcagacagaaacctgggcaaaggaaccttctgctgcacgtatgtactatttcccagagatgtaaatgatttttttctctctgccccagtgaatcacatatgaaagttctcaaagaattagtaaagaaaaatggtgaaaatcttcttggtgttgaaggaacagtggagtgtagctggtatcagaagttctgaagtgactcagagattcagaagggtgacaggcaggggcagtttttactagaggaaagagcgatgtaggatgaacaatttactgtccctgttgattcacataggatgtaagtacaagagaagtcaaggatgtccccaaatttcttgcataggcagcagatgagtgatgtcattcactaagacaggaatcaaagaaaaatgaatgacatgtcatatcacacgtagaatttgtagaagctggagatgtatagcttgtttaaaaggggggtttagtatggagggttgaagataaaaggtcaaatatgtgaatgactaaatgtggaggaggaattagatttaccctgagtggttccaatcttgcaagttctcaggaaggaaatctgagatcaataaaatcaaactggcccacagttcaccacaccagttgaagaaaatgagctgccggcacctgtgtgagtggaggtgctcctcagttaacacttggtgagtgcaaagaatgcagagggcatttgagcaccgggtagggatggaaaggtgacttttagggtctttgttatcattattattctatgggcattcttcatatataatatttagagcttcgattctgggccacaagttgatctgctattcctgaactactacaaatttgagcataagaatcttggcagaataaattatcccaggactcatgattgctgggttctagcaatggatatgcattaatcaggcaaattattcaatcaatcttgggccttagttttctcaactgtaaaaggcagtatttaaactgttaagcacttttaactcagcaattgtaggattctaaaaagaatgtatgtacttctacgttatgatgaaagtcactcttttaagtttaaagaaaaagttcctacaaattagggtcaatttatattccaagagttctggctgtccctatcaggcccctcctccccctccttgtccttatattttcacatctgttagaagaacagatcttaatggtcctattctcgttctgttactgtttgggatctgaatgtattctgagtgttttctgtcttccaacagctggagagatcaaagaactgttcctaaaagcaaggacaagctacagccaactgcatatgtaaactttcatactgatgtatttagcacagtgaattatacccccataatttataatatgagaaggtaggtctaatccaataataataaagacctttaggagaaaacaacaaaaaacaccattccagcttccagccagtggtctgaatactcacagcctaatacaacacaaagacattccaatacaatgaaataatttggatcatgtccagcctctattttttaggatgatagaaataagctcaagagagctaagtctatttattattcagaagaaatgaaagtcatagcatacacttctaagccaagagatcattgacaaaatttgctaatgaaatcaattcataactttctttcagattttcatttaaacggctgggttcctaatatatttcaaaatttacactgattaccctctacaaaaagtatgtcataagagaaaacaatgattacagagtagcaagggacttactttcacaggaacggtgctttatgttgctgaaggcaattacaaaaagagagtaagaaaaattaaaagcaagagctagagctcagaaaaacttgggttcaaatcccaactctgttactcactagcaatttagtggggcagcttacctagccttgtagaatgccagtttcccttttgtaaaagtgtactaaaaggtactcgcctcctaaatttattttgaggataaaatgattaatataaaaaccctattacagtaccatgaaaatagtgaagccttaatgaatgttagctgataataatagtgctgtcaacacatgagaagaattagaatctggtgggagatgaagacctactccatgttctctgttctgtcttcttgccctgaggggtgtgttcatcaatatttaaggaactagaaggtgtgcatcttggatgttaaaaacaggggctcccctcacctatcagtgaacagccccaataccagagatgattctatacaaattttaactggaacatctaagataaccctgagaaatatcccaggcatatcttaagcagcctgttatttgagggaacacagaattaacccttggttttatccttagaaaaatgggatgataacatcttttttcacaattatcttcacaaattattataaaatagttatggcagagcaaaaactattgacatgggtatttgctaccctttcccctcctctcttcagataaagagaatgctggttttgcctcttctgtcacaaccccctcacctgccccccgatgaggattcaactattgctagatggattctttgagttttcatgatgcacaatcaaaagacaggggataggtagaagatatgggcttgagctcggcagggagaggggggcggtttaccagcgggagtgttggggagattttggaagagacgttagaaacatcaaagtagatgggaaagaaaatagggattgctagaagtactgctacagattatatatcccctttaccatgctttgacagttaaagaacagaagttgttaggtcactttaaattcacctttggttgactgcctgtttctttgacagaatccctacttggagactggaccaaagaggctatgtcttccatagaggcaacatgagaaagtaagagaggtgcaaacacatcatgcaaacgttaggcagaatttattgtgttcatacatgacatggggaacattgaaaggattgatgtcttagaaaggcgtgttaggagtgtgggtctagaatgcataaggttagagatatgcctgcactgggccatcatcttattttaatatttggtccaaattctgggcttctcacaatcagagagctatacctaccaatttcctcttattattcttggctgcccggtccccatccctctactcagagatttctcaagctttgcactaatggcattttgggttgaataactgttgtgggggtttggcttgtgcactggaggatatttagcaacatccttggcttctacccactagctgccagtagcatcttcatccccactgctggcaagttcagggggggtgtgggtgggggaagtcttctccaaacattgccaaatattccctggggagcaaaactgcttctggtggagaacctctgctttaccccaatcatccaggcttacaagaaaaattcatactccatcaagccattctacaacacttcattttcagagtttccaactacagagattccaagttctcagcaattcataaccattacagtttgcctcatgttacactgactgcatcaggctgtcatttagaaattataataatggctaccacttgttggatattttttatgtgctaggcattgtgctagggacttaacagggtgattttcattcttatacagaagtaagtgtggccgggcacgttggctcgtgcctgtaatcccagcactttgggaggccgaggtgggcggaacacctgatgtcgggagtttgagaccagcctgaccaacatggagaaaacccgtctctactaaaaatacaaaaaattagctgggtgtggtggcgcatgcctgtaatcccagctactcaggaggctgaggcaggagaaatcacttgaacctgggaagcggaggttgcggtgagccaagattgcacaattgcgctccagcctgggcaacaaaaatgaaactccgtttcaaaaaaaaaaaagaagtggtagatattattatctccattcagagatgagtaaaatgaggccctgaaaaattaaaataactcatccaaggtcacagccaataagtggctgaactggggtttgaacctaatctgtcccaggtccatagtctctccttgtctcaggccacactgtttctcctgatgagaaaaactaatgcagggatacacaagaaatacatttacccaaagttacatgagttcaaatggcaattccactgtatggactattgtagaggttgttgatctcagcactatgtggactcagcagtatggatgtctttgttctagggacatcaacaagctgatttttgaattatgaattttctgcagaaaataggaaaatggtgctctcctttaagtagaaacaacaaacagtagctggttgccatggtagcagaggtaaacttaaccttgactgggaaggcaatcaccagaaagggacagcaagtatggtcaggagtctaaaccagaccaggggtattttaactggagaagagaaagtcaaaggagagaaatgatagtcatctttagttatttgaaaggctactgtgtaactgaagtgaagcatacattcaagattattctaaatggaaaatccagcattcatgagtggaaattacaatgcagtcatggaagccagttttccactgaatgataagaaagaacatttaaccatcgtaatgttccaactggattgaaaaactaaacaagctgtctagagagcaataggtcgctaaaatagaaagatcctaacaggaaggtcatctctcttgggagacccagtgtgggtgagactgggctaaacaaattctcaggccccctccccaagcaaaatctctgtttctccagagaattagtaaattggggttccctgttgaaaacagacaaatggaaggtccactgggcggaaagccccagccgctcatcactacaagaggagaggtaaactacaatctcacctgggaagaaaatgttgtttaggtgacacaaaccaaggggaggagaaaccttgtggaggatttttcccctctgttctgaatagatgatcaaggggtaaggcagtaagggcaaaaccaaaaacaaaacaaacagaaaaaaacccaccaagaatcaagcagctttctgctgtcttccaaccctcagacactctgatgcctctttcttggaatgtaccgccacctcccactgctttggcctaaagactgcatttaattttaaaaagaaaataggcaaccatccagctaggggacagttagagtaacagttgattagtccttttctaaacactgtcttttgtttcattgctctttatttgctgtacaccaacaattcattaaaaacatctcaccactagatttagtgaatggagaggacaggtctaaacccaaacattcctcttggaaaaccgactacattgtaaatttgcagacctgtccaggaaagtaaaactgttacaaagtcaacctctactgaggcacacagcctcctttgtaaaagaaaaaaaaaaaaaagaggtgctaaaaaaatgacaggtttttcttaaaaaacaacaggtttttcttaaaaaacaacaaaatcttattcatctttccatattcagcatgaagaacacctaagagaattttccctatcgcctcatctccagggcactcaaagcatttacaatctcattattttatacaacacccattaagtgggcaccaaagattattacccttctttgatttctaagaaagcaactacagaaagtttaaacaagttgcccaaggtcgttcagtaaattgagatgcttggattttccattcagtgattgttctagggacatagtgcaaagtgactgaatcctctaaactcaccaaaacccctaagtcttacagatctcttccccatttctcaccactcatgagattttcatcatctaatcacaaatctgccaccatgtggatcttggacatgggtatcctaccaggccagtgccatgtctgcaagaagcctggtgctacacctgacagctttcaaatcaccatcaaatgattcctttatctagtgaagttgattctgcctggctgcatctgggaaatttttaacccctcgattagccattgcacagttggcttaacttggatgagacagaggacaaaatagtggtggtttaaaaaaatacctcccccattctgattacaaaggaggcatgattaacgaagtaccctttgtatccgagctccattctaagagaaagagaaagagctttccttcccccttttttgatcgctgagtcttttcctacttgtctcatcacccacacaatctgttcacagcccaaacagacaatccagccagtctgtggagagttcctaaaacatttatgttgtgaaagcagacaggatgaacaggacctcatctcgacaaaggatgatgggacattcagcaaaagagttcacgaagggaaatacagatggagtcccagagctgaatgaatttgcccacaatgtctaacacaatgccagcccttatgggtacttgtaaaccttctggtcaattcacagccacctccaggttttatcccccaaattccattacttttagaacaaagggttttaaaagaaaatacaattaacaagttaaggaggtccaaatcagtgctttaaggatccttcaatttctctagacctttaaacataaaaatagcaagttagatgaagattttagttccaacactaccagatcgggagttgacataatgcacataaaatacttaatacattgcctggtacatactaagtactcaaataatattacctaatattttcatcttacactgctctattttattaatgatgtttttatatatgtcattgcctgtctactcagctaaatagttccaccttatctgtttttggtataatccaaaagataaatgccttcatataattatcttatttaagctttcagatctatagtaggttacagatgagacagtaaaagcaagactaggtctcatagctggcaagtggtagattcccatactgagatctcaactcactaatttaacatccagtgctttatttcaataacaccacagatgaacagattatcatctctcgtgcctctttgtattcttcagaatttagctaagcgctaagatataccttaatgatcatctaaaataaatttctaatgataggtaacctaacatgtctgaagatttattttagtgcctttaataaggaagaaaagaaatgggtggaaaagcccaaccatacttggctttgaggaaagacatgcctctgtttttatttgccaagggaaagcattaccaggtccatttagaaagacaagaggaagtaaagccgggcgtggtggctcatgtctgtaatcccagcactttgggaggccgaggcaggtggatcacctgaggtcagaagttcaagaccagcctggtcaacatggtgaaaccccgtctctactaaatatacaaaaattagccaggcatggtggtaggcgcctgtaatcccagctactcaggaggctgaggcaggagaatcacttgaacccgggacgcagaggttgcagtgagctgagattgcgccattgctctccagactgggcaacaagagcgaaacttcattccaaaaaaaaaaaaaaaaaaaaggaaagacgaggaagcatgagggattcaatgatataccaaagagataaatggggctagagccagaactcttgatactctgctcatggctttctgtattaagttcattattaatttggcaccttgagtgagatgaatcttgccttggattatgcacatcaagttgtatttcagatggctgtcccatactttaaaggcccataccaaacccccatgtatcaaaaaaaaaaattatctgatctaaaaaatgcctagatcccttagcccttaacaacaaactgtcttattttatggatcttgtcttcccaaatttaagttgctggagggcaaaatccatgtgtttactccttctgtagcccatggctaacctagttcagaacttgtagcaacgtgtgctgctcattgcttcctcggcctcacagccttctagatgtcccaaagaaacctcgagtcatcataacatctactgaatttcccaaccatccccagcactactgctcggcttgggcagtcattaaagcttctcttctgccttcaggatcttcatttcagctgctgggacatcctgttgccatccatttcacacagacatccagcccagcaggaacccgtgttgcaatgagctttgcttcaaagccagcagcctggccaagttccaggaattgtcactaatgatcttcaccagcaacttggtgctcaacagtgatctctgaacacacacacacacacacacacacacaccccatttccaatactgctctagttagaggagctgcctaacagaggttggttccataacttattttattctttaattgttacagaggacttatttcatcaaaataagctaactgtccaaatacactctgcaatgcagcagtggcctccaccaacttactccttttttttttttgagatggagtctcgcactgtcacccaggctggagtgcagtgttgtgatcttggctcactgcaacctctgcctcccagtttcaagtgattctcctgcctcagcctcccaagtagctgggactacaggcaggtgaaaccacattcggctaatttttgtattttttaatagagatggggtttcaccatgttagccaggctagtctcaaactcctgacctcaggcctcccaaagtgctgggaccacaggtgtgagccaccacatctggttccaccaacttatttttaaactgaagaaggcataacaagtgtatcagtttcttttggttgtaagagacaggaaagcctgctcaaagatacttaagcaaaaactaaattagtaagatgatactgaaaaatatctagagataaagcagtcttctagtggttgttttgagaaatcagattatgtcaacagatctcacttctctacagtcattgaattccaccctgtattttattagcttcattctcaggcttcattggaaagactccaacaattccaggcttatattctgtgagttgaaattcagtaagaaaaagagaggacatctcttcctggtagcctccacacaagtctcagaattcactctaattagactaacttgaggcataaatccaccgtggctagtgcttggcttggtcacatgtccatcactggaatcagaagtgaagattctcttaaggcacatggactgagagtggggaaaaaaatgctccacaaaggagattcaggcagatcctgctgccaaaacaaataggcgaaacactaggcagccaaaaaacaccaatcatcctctccaataaatcttccttcttttcctaatctccaagaagttgtattactgggatgatccaactttgaaaatagtatattaaaagaaaggaacaaccacgcaagtcatataaaaatatatgtagccagtaggcacatgaaaagaggtttaccattactatcaatcaacgaaatgtaaattaaaagaataagatattatcagcacattgggaaacattttttaaacaaaagtaatcaccagtactggctaacatgcaaagagatagacattcccagatttggctaatgggtgatatgatgattatcactgaccatcaaaatccttaaaaatgtgcatttcattttacctaagataaattcacaaaagtgaatttactaaggaaataataaaggatgtacataagaatttaaatacaaagaagatttctccagtattgtttataatagccttaaactggaattattctaaatgtccaacaatagattgagcaatttaattttatccatactatgggttatcatactgacactaaaaataacctttcaatgcatgtttattagcatggcttaaataagtagaaaggcactatacaaaagaattaataaagtgggcaacaatagcatcattcactaactaaacccagtaaattagtttcaccctcatctcctaggcactccctggttccttctttaagatttaccctggggttctaaagacccagattccacccggggaaagagaaaaactctggacaccctcagcaggctaaaatgtgttgaataaatatgtaaagagagaatcaacaactgttcatgggaatggcttgctacacagaggagggtgaagaagatggaccacaactgtcatttacttgtcctggaagagagctcaaaaagaaatgtttggccaatacacagtgatttctatcacaagtagttcatattttttaaaactactcttttttcttgttcttcaacttgtcataatgtagcaattaatattcaaatcccgagttattccttccacaaacatagctactgccttgccaaataaaccataccacaaacagttactccccatctcagttttcataagtttaaaatgtaaatatccctgatggactggcctatcttagagtgttgttgggaagatcaaataagatgatttctactaaagtaccttcaagaaggataaaagcactatacaaatgtgaggtatcaggtgtatcagtgcattacgcagatttcacaaacacacaacagagcatgggagagttcatggcaagcctctggctcctccattaccctcatgtccttttccctgcagtcatttcagaaaaccagatgtttgtttgcaaagtttctctgcagcaaaagggcaggccctctctacattcaaattggctgaagctgtgtttctagctgttgaaacttagacaataatgggggagatgccaaaattaatccaaaaagcagacaggcacactttacagactggagccctgagatggaaaaaggcagcagcatgaacaagtagagggttaatggttttcatattatttaattcaagccgcaacaatgacagattctaaagatataaacttctgagagtgagcattctttcagaattagtatacaggggtcctattagcaatattttatatactccaaatatcttcccaaaggaaatcactgctgaaaaagacaaagttctttgttggtagggctgtgcgtttataccatggacttaaatacttttcttctacagtctcctcattttaaaaaatggcaaaaaatttcaataaaacatggatggagcaataagaagtacactgaagttcttaaatgcccttctttttaaatccccaccccaattacgtccctcccttgaggatatttacagtcctctatgacacatgctctgtaccttcttggttcaaggaaaacacacctacagcatttcaaattaactactgacccttactctcacactataaacaaacccttttcacaatctcaattgcattgtgtccacattgattaaagcttgaagcctggtgacctcatgtggtgttaacttctcccatgcaccaacagcattccgcctttctactcaattaccccctttggtgccagaggatcgctacccaatgaacacatacaatggacttctgcttcattacactaaccaacagcaggatagaaataagcagaagaggaataaacaagctaatttatcatgaggacagagcaagctttcaccagtctcgccatggaaaacttcagtggttaacgggaacatcaatagtctgggggtgatgtttatgatcttacagattatggacaaagccataacagaaccccaaactgactgaagaattctgcagattggcaggtgtgaacacacgcacacaaaacccatgccttaaaactccggggtcctacataaaacctactcagtaattattttgggaagcataaccctgggctttggataacgtgggctgacactctggtaatttgctccaactgttcagcttaactgtggggcccctcttatttatctttgacaaggtggtcaggaggaacccagcccctttgtgagaggggtctggttcccccaccgccccctgcttcattaggcatggcaaggacacagcggttgattaaattaacaactttggagggcttcagtcccagttcccagacattagcaccatcatccagaacaaattaaaagtctcacagcaattaagcagattttgaaaatgaatttcccatggttcaatggctcaaccacaatcttgagttaagtatcagagaagagtattgaaggaagagaagaggaactgactgctgaaattccaaagtaaacatacaactggtagaagcagcatacacaataaacttctgagcctctgctaagtaggcttatacatttcttttatagaaaattggaaatattcagtcacataaggggaaagaataaaacattaacatagaatggttgtatcaaaatggtggatttttttttcttttttctttgtttttaattactttaacatcattttattcttgttcaaaaatataaatagatattgagaggggacaaaaatacctacttccagtcacaggcttttaaattcaaacaagaaatcgtacatccaagtctggaactggaatcatctatatttctctgaaccagtacaactaggttcacagcaggcaaagaccttttatgccagcctccaaagaaccctgggtgggtgatttacctctaagaactcatttctggatcaaaagaataagattaatgataaaatcatacctatcacattctaggtgtgtactctttgccaggcactgccgttttgaggccttgtcatacttgcttccttccctttcagtttacatatgctcctttaatccctgttcccgcctcgcacctctgcctggctctacttgcaagtcacaggcctccgttcctctttgcctgcaggcagacatttggcacagcttgtgtgcaggaacctggaggaatcctgaaggaatgtgcgaatgaattcattcccactcaccagatctataagctgaagacagtggaatgcagaggtagttacttgaatgaactatattttcctgtcaagggcatttataaaagctgacatcataaatacattattggtctctaagtacaactgtaaataaatctacaaaattcttagaaggataactttcaaagatttgtttttcatctttaaaagtttatagaaaattaagcaaactatgtggctcttctaaaagaagccccttcaaaatagccctcacggaacagaagaaacacatttacttcttaaagacagtaaatctcaaaatttgcattacagttcaacagttccatttggatattcaaaatttggaaatatatatacttctgtgtgttcccttcttcccactaaactttaatcaactagtatagacaaccagccacagtcaattatctggctttatggccaagtagggaccaaaatatataacccagacataataacaatcagcataacagtaggcataggtaatgaaactctccgctagtggtcagaaagctcagttcaaaccttatttctcactatgtcttccttggaccttagtttccacaatataatggaaaaacgtccctttccaactccaaaattgtaccattttagaaatgtaagcatgtatattatgaaggtaacacaatcttttatgttcaagtgaataataaaaaccctcctcccatttaaataataatagcctggaatataatgttataaaacttagggaggacctcaaagccttaaagtagaagcattttagttacctccacaataggtccaaaatgcaaggcattcatctattcacctcttcaacagatattattgggtacctacattgcattgatctgtagtaacagccataaaggtgagtatattagaccatcattattctcatacagcttacagtttgacagaggttatattttaatcattattttttgtttaaaatttcttataaactataattctagctaatgtttcagaagtaattaatattttatttttaaaaatcatttttcctcaaagtttgactttaagaagtctttgtcattcacgttattatctagaagcaaaaaaatttcccagtggatgatgactccaattttataatgtaaaacagaagtacaactgggattcacttcgcagcaagcaaagagggaataaatctcttccacataatgagtgatatccatttaaaaaagtcatgctacctgggcttatctatgctctaaagagccatgaatactggcccagaattttaaaagacaaacatttagattcaaattaaatgttggttaaaaagaggaaaaacaacccaagttaattactctaatttaccgaatatatgaatgacctgcttattggactattggctagcatagatcttgcctaataggaaggctatcaagcagggtggctgggtttctaattttatccaatcaattaagaggcagaaataacctgcccattgaccttacgagacacaagttgactccagaataaacaaacaaacagacttgaaaagttaattatgggcaacctctccttcagagaaatggctcacatatattaattgatctaacacctatgtgcaggctcccaagaagatggaactcgttctctcatttaaatcccacaacccccgtgactcagagatttttggttcaggaaactgaggctcacagaatttaaatggttagtctaggttacaaagcaagtttgataacaaagagataaatcagatcactgccatttatcaaccataaaaccacattccatcagttattatagaaatccatcactttgaatggagagatcaagtttctcaaggattaagcttctcatttaacatgaactatcaaatggaaaacctcgagccaacacttatttttatagcgtgactatttctcaagaatcctgtaagaagcccacatcaagaggcaactttcaaaattactaaaatttcaaaaatttcaaaattacaaaagtaacagttctgtcaagtgggaagagttaatgcctttcctttacagagctgctttatgtaactagccgaagttttaacatagaaatattactgtttcatatatacattaatcttgactttgttaaaatcccaaacatactgctcatcgatctcctaaactttctctttttcaagaagtaggtgggggagggaaggaaggtattggaggaattcttctgatatctgtaaaaacagaaacaaatgctaattaaaagatgaccttagtgccctttcagtttaaaaatcttgagcatttacaaattatcttttttttctctttcatcaactattacccagaaataccacattctcatagagcaaagctctgtcctgtttgggcatgttcaaagaatagtgccagggatttaatactggcatgctcatggacctgcaaattctgaaattcagggggaggcatgaataaaaagatagctgaggtcccacagttgcctgtcacagccaagccccaccccacccacatcctcatatgatcctcaagaagcaaaacctttctgagatattctataagtgacagcaaggcccaatgtgcagtcttttcaaagcctcagtaaaaatcttatctatgacttcacttagcccagacacacaggagctaaaaggtaaaagcctggttcacacaagccagaactagctcaacagaaccgaaaaaagaaaggaatgtcttttctatatcttttccatgtctgaggcattctgctctggggcaaattacaacctaaataagaacagataaaatatatgggaactgagtaaaagaaatagaacctcaaaaagggctgctctgcctggaaagaaggctggaattcataaaacatggaacgtaacttttttagtgatcacctgaaggcaagcttgttaaacagagacttaaaagtcaagatttatttcagctaaattagatggtgcagaaaaacatagtgcttcgtgactctgctcagtttcaacaaaatgaaaagacagaggaggaagaatttacagtataatacttgcaccactcaaatcacaaaaatacacttgttagtcacaaaggaggggcccataacattgtaagccttattttggcaatgtgaattttctgcttgcaattaccttcaaagtgaagaaatggcagagacgaagaatgaggaattttgttgctgcttttgtatgtaaattcgaccaaaatatatagtgctatgtgactttaccccaagctcactagaacttcggaattatgcctgccacaaacatcctccgaaagcacaagaattagtcatagatttttttagtcaaggaagcctcagactgataaagtcttaaaactagacgcaaggactgtgctttggattggataagtaatgactatactgcgtggttttggtgtgtgttttttagagttttaaatttacatttccccaagcaggaggaagggaatgtaccacaccctcagcaagcaaggaaggaatttagttgattttttttaaattctgtagtgttccttaaaatccacatagcatagcataacattctatataattctgttgttccataagggattggctaagtatattaaggatacaaagggaagggggagatgacaaagttattgctattttattttcaagtgacagaaaaatcaatcgagctataagaagcaccagttgggaatgttctgcacattaactctttaatagccttagacagaaatcagatgatcttcacactgaaactctgaaggacatatatctttggggcactgagtagcattagaaactgcgtccaagccatggctccacctctaattgcatgaactgaatggcttccctttcctgggactcgaattccttctaaattaaggtagaacaagatagtcttgaaggccctttcatccttacgatttaatactgacaagctcttcagcttctattcaggacaaacaccaccaaagtgtatggatacaatggattcaagtagccacactcatggacagtgacaaaatcccacagctttagggtggaatcaagtatcatattggcctagaatgtattgatgctgccaaggtgtggggtgggggtgggggtgggggtggggggcaggggtgaggtaccactgatgtgtgaaatgacttgcctaatatcccagagacccctgaatcccaggcattcttattctgaatagagacttttaatcaatttcttgtctcatcctatgtcctcatgttaccatacttctacaagtctgtgctgccagtgagggttggcaaatcatcccaactcagaaggacagacttacaaaatggcataatcaagcttcactaacactgtatataaagtaaaagtaatagattgagtaaaagcatgagagattctcttgggagtaaaatgtgcatgctttaggagaagatttggacttgtgttcttatttgttagttttctgcaataacattaatatttatcatttgggggaggttcataatgaaatacttggttatagcacaggaactaatgttagaaagcaggatgacctccttaaactttcaaacccaaaccaagtaaggttttgggtcattcccattccttctgcctcaacagatctacaaatctgtaggtgttgggcaaagtggtggtgactcaaagaaggaaaagaatggataataaacagtgtcgtgtgtaagtttccccagatctaagaacagagagggacaaagaaatgtaggagagatggatttgggattaatcaaatggtttcagtgcaaagtcctctggaaatcacatctctgataggcctggctcaatgagacactccaacaagtgtcaagtcctcaagatagtagattccagtgatattttatgcttgtagcaatccccatgaggaaggagggctctgtttcacatcgcagttgagagagggagtcaatgagattttatgacttttttgggatcattgaggccacaggttgtctgcagagtcctagccaagtttctctccactaaatgacgctgctttgagaccagaagctctctcttttggagggggtcagccaggaccaaggcagcagttaactggcctccaaccaactttcatgaggctggccttattaaactaggtctgaagaaaaactgagtcaaccatttacagacttattatcttctttctaaaggaaaatcataatgccttgccaaaacaaatgtaataacttggccttttctttcaattacctctgctttcttggaaatgtgtatctgtggataaaacctctgagttaacccagggaattaaccagatgtttaagaagaccctgtgattcctgtgggccagcaaagaaagaataccccttggccacattatgagaatggagtactaaggagaaagggggagcagaaaattaaacttgaaggcccaggatttaaataggcatagcagatagaaatgttagctcagttttgggggattgggtgacactggaagcaggttttggaaatccaggcacaagctgtgtccttgaaaagacagtctcatatatttccagagcccttcatttcattttcttcagtctatattctacccccatcttcctattccacatcctcattacactcccatttcttcaacagctaccttcaggacctacgatgtatgctaaatccagggaacattcagagggcccactatctcgacaaatttcctattacaactctaagccatcttttgctgtatgcaataatttcctttggggagtgttggcatgtaatttctgaggttcagccctccctagcatggcccagaaacactgccaatatttacaatggctggtgtaggcagttcttatgtctcaggagttggggatcccttgttaaggaagtaataggccaatgatcagtaaccatgcagtgatatgagtgcatggtttggggaaggggtggaagcaaaacgaaaaggtgggggggattgagctttcatcttctgctctatctgtgtagaatcagtttcaccacactcatccctttgtttcccatagaaatggaaaggacaatgggaggaaggtagcattaagcttaagaatatggcttaggattcaatcaaggactgtgggcttgagtcttagccctctcatttactatctctgcactcttatttactatctctgcaacctcaaaaaaggttcttaaatgagcctcagattcatgtgaaaattgaagaaagtaaagtatttacttctttgggttgatgtgatcattaagtgaatctttacatgtgaaacgctttccatagtcccccagtcttccaatatgattactgcttttgctcccctacaagatttagtcagggatagaatgtggggggtggggggaagaggtggtagtaagaggctatagaaatttagtatttttatattataaattatacatcattattttctttaatttagcaatccttttagattcatcattttatgagaagaaaacttagaaaacactaaagtttgagatcattaagtttgagaattggcatgtctcaagctcctcctctccttcccacatccccatacgggcactttctctagaactgtgcagagctggcacatttattaggccaccatcacaacccttcagagaaaaagtaagacctaaatgaaatagtcgtgatcatttcgtgtcttgatgctccctgtgtctcattacctctcagggtctctatcaaaatcaagggctgcaaatctttcaatagagaaatctattagcatattttccaaagaacaaaatgtacctattcctgctgtcagggctgctgtttgtaggagtctctggtttaaaaggccctcgttattatgcatgggtgtgcatacaaacaaaacttctccgcatgggaaaagaattttcagctttcagtaagaggctcttttctcaattcctccaccatcactaccaacctacaccctctaaaaacctctccaacctccactgattctttctttcctctcctttgaaaaagtccggacttactgtataactacatatatgttaaaatcaccaactagagaaaataaaattgagtaatattcttgcaagtagcagaatctcaaacatttgatggttaacttggctgctttagtcaattggatgattcatacaattatggggactggttagaacttgaatggaattggttggactggcacaggcaaacttctcaagacatgtcctcccctcagccttggcaaggcactttttgggtctgtacagctggactccatttcatttatcatcacatttaatattttcttccttttgatgttacctgattataaaaatgagaaatcagttttagtgctattctcatgtttccctgcattcagatttttattcaggcctaaaagtcaaggttttggggaaagtgggaggatcacctaaagttgataatctaggctctgatgtccgattgactggagttcaatcccagctttgaccacgagtagctaggtaatcttgtgcagttttactagatctttctgcacctcagttcccttacatgtaaaaggggtacaaaaataccaatttgccaaggttttgtacagatgaaattagacaggctttggcacatattgcacattcaatacatgttaaacattttatcattttattaatatatctatttcaagatgaaatattaatataattagttgatggtataattagtaggggttctaatttcatacattctcgaattcccaataaataagtgaaaattatcttgatgctagaaaactacatcctaggaaatcttttgttgtaaacttagatgacgaggggctcttttctacccacagctcccctagtttactcaagctccatgtctcctctttaccaaccccgtgtcggcatgtagccccatcctgagcacacagtacaccctaatagatattttgcaaatcaggcaagtagcacacaggagttttaaggacctttatataatttcaacaaattcaaaattctaaatctccatagaaacacctttatgaggaatataaggtaagaaatatttctgcagtttatatggatttaaacattttaaggtcaaatcattgtaaaatgtcatgtaggaagggaaggcctgaagtctcaatctgggtttcaggcagggaacctgaaaacctcacaaagccacacataacactattagctcaaggaaatgtttctcactgtaacaggaaaagggaaagttcgaatagaagtctagacaggttgtactgaaagaacaatcagatgaaagagcaattcaagccgggcatcttgtgcctgtaatcccagcactttgggaggccgaggcaggtggatctcctgaggccaggagtttgagaccagcccggccaacccggtgaaaccccgcctggccaacctggtgaaaccccgtctctactaaaaatacaacaattagctgggcgtggtagcaggtgcctgtaatcccagctatcgggaggctgaggcaggagaatcacttgaacccgggaggcggaggttgcagtgagccattgcacttcagcctggctgacagaacgagactccgtcacaaaaaaaaaaaaaaaaaaaagagcaattagagattgttagcatgagcatgattacactgcaagaaccaaatagttaagttttttttaagtcaaatattgtaatttcaattactcttttaaaaaagagtaattgaaaactctttttaagagtttacaaaagagtaaattaaaaacatgctcttttaaaaaagattaatttataaggttgcacagtactcctacaaaccacattagatacttctagtagttaacaaagaggaaaacaatgacattttacaaaataaaaagcagaattgaatacagaaaaatatgacttaacatcaaccaaaaaccaattgattaatcttgtcaagattcttgtcaagattctcaccagacacccaaatactgaaggattacaactattgcatcattaagatatattaaaagaaatgcaacaagcttaaaatctaataaattggagagtaaacacatatactctgcataactgtaatttaatttcttaaaattctgcaacttccaaataaacaacagcagcagaaacaaaagctcacataaatgggtcacagtaaagaccagttgcctccacttaaacaatactagcacaatcgtgtgggctacatccttgaaagaagtagataatccatgcacaatttgagaaaattgattacatatgtgtgtatgttatatcttatacagtatacattacatcctcaacattaaaaatttaaaaaggccactcacataagttaccttttggaagaaacaatgatcttttctaaagaaataataattggtgatttgttgatacttacagtttatgtttggaatagtctcatttatgggtatgctgaaaacaatgcaacaattttctattaatccagttctgatcttcatactcttagcagttttagaagagctgagaacagtgacctgctttttcaaccattatatttctgagacatgactaatttgaagctgagcaaattgcacataatgggattcaagttcatgatttttagtctgcactctcttttcagggtacatggtctccttccctccctgcttctaccaccacccccaaagctgccttttcaggagctaaattcacccaacatgaaatcaaaagagaattatttttaagttttctgcaggcttatttttaaggaggataaagttatatttttaaaaatatttatcttttccttcaggtactaccgcatttttaaataatttctaaatatttagaatgtatttagatgtatttagaatagtagatgtatcagatgtatggtttcatagtggctcaaagtttttaaaaaagcattatataaatcagtgaatttataaataccctaagttctactatgtaagatgttgctttcagagcctttttgcaaaatcccattaaaggtttagcttacagacactggtgccaaaaaaaaaaaaaaaaaaaaaaaaaaaagcaagcaaaaaaatgtgtttttttttgtttttttttttttttggtaagaaggatgttgaaataggagaatatttaagctggctaaaccaaagccaattcctggaggctagttgcttttatagtgaatgtttaaattttctccatcaaatctagaaggctacaacgaaacaacagcctaaatgtcatgtacaattctctaagtactgaaagagttacacaattttagaaccgaaagggaccttaaactccttcctctaccaatgaggagcctgaagcctgctagttaactcacttgcctggtcactctggggttcacggattgttattgtttggtggggtggttgtttttgtgctgtatatttgtgtgtgtggtgtatgcagtactcacacccttacaaacaagagctttgccatttatattctccccttcctaagttgctcttcctaagtttactttcatcagcaaaaagagtgatcaaaaagaaaaatatattctggccagttcaaaggggacatttctttttctcacttggcctactgcagatatattagagagacacttcacacccaggacaactgactttttaagtggcaataacaatgagcagcggaggagttctcttctcactcgagagagcagaggaggtttctgaactttaccttgacttccagcctacaaactgttccttcaactactgtctccgcttgcccactttgttgctattctttccttagtttcctttgttttccagcttagggaagtttggtgggaaaatttttcacttacattttgttgatatttatttcccatatttgggtcctacccaaattttagatttaagagcaaaaaaaaattactgtttaagtgaaagaggaaaggctaagtcactgttcaacatgggctagatctgatctgaattggagacacagcctttgcaattgaggaaggagaggtaagcagtaaacttatacagtttcctccaagaagtgttatacatagatatttttcaaggaaattggaataaagcagtttattaattgaggggaagctagttacagttagcacctgccgcggactttttgaggttgtcgtcattaaccaaattcttcgggaaaaacaatctttggcaccacttactccagacaaaccctgtttggaacagacaagtgttctgaccctatagtcgctccaatgtccaccagccactcacgagtgcccttagggcttctccttggtggtagcatcccagaaatcctactagtttcagaagtgccctaggaagcctacttcttggataatgggctctgtctgcaaagctaggagatcagcctagaaaaagaaacacaccaacaaacaccaggaaactatgtgtaatggtttgctgcttgtgcaaaaacctcaaagaggatgaaggtcagacagggataataggccaatttaattctgaaagcacaaggtgcaagaaattttaattatggtctgccactgaaatcacacaagatccaatggcatctaactgcaactgctcatcaagggagacaagaggtgtaattgtaaccgctgcataatcactgtgagggcacagggaaggctgccttcagctcccagcagagaaggtattaagagcctcgaaaaatccaatacggggaaacgagattgcatgtagccaaacagaagctcctaacacaaaagccaacccgtgtgtgtgtgtgcgcgcgtgtgtgtgtgtgtgtgtgtgtgtgttgagggtgagggttccagaaagaaaatgtgaagctgtttggcccacactggggataagagattgtttgaaaactctgaacccttttctgttttgtggataaatgcacacagagaaaagagcactgtctcctttaggtatttctctccttgatgaagcttcacccactctcctttgtttaagacaattggcttggatgttaccgtgatttacagtaccaaactccctttaatttgttcccatcaaacccaagtctggagacaaaacgccaagcacacgactggaggtgcccaagcctgtgcagctctggcagcgacgccgccggcgcccccgggcgttttccccgcaccccacatcgcgtgggcgcccgtaaaggcacgcgcggagaaagcccctccgtggactccccactccgcaaagtttaacaaagccgtgaagtaaggaaaccgaacctcccgtccgcgcccgctgcaaagttggcattgaagtttgtgccgggatgtcccaaatcttgagggggcggggggcgcgagtgtgcagagaggcgggaggatggatgcagatggggagacagtgaggggaagggagtttttccgagtggacggtccgtgaggcggttttcttcacccggaagcctgtttgactcagagaggtccgggaggtgcacgccaggggaggtctcccggggcgggcgctgtcgccgaggaggccggcgagctgtcacctgcggggggctgtggtgggagctgagggcgctctcctaagcgccaaaagaggacggggacattcacagtcaccggctctcggggctctaagtagtgggggaagggatattcacgagtgggcaggaggccaaaagcaacacctttcggatacgcttttcccctccgacctctccaacttcccgcggcgctggtcaaggactccctcccaccccaccccatcccacccaacctcccggccgacaattcggacctgtccacggcagagcgtggggtggagtgcggcgggaaagcagagggcgcgaaggtcgggaccccaaattgcaaaccctcagcccctagcaaagacgaccaaatgcatttacaaccgtgcaagtatctcagccttgtaacagagctccgggtttgcgccgggcacagttccccgactcttctgttgttcctaataaagtcgattacgttgccctcccggagctgattggaagggaaccgagaggaaaagggggggaacgcgggaaaaagcgggggggggggggggcgagcaatcaactttgtaacccagcgcttcctcgcgcgatccgtcgccatgcttaagattcccacccccgccgcccccctcttgcctttcaagtggatactgaaactaggccaaaactttttcccctccttttctcttagccactagactggattgtgccccacggagccccatggagctctgctttcttaagcacaatagccggactaattagatcatagaagcaaggcagtgatactgtaacaagtagcccaagaggcaaagagggaaggggcccgaaaagacagaaagggggaaaagtttgcagctctccgcacttaccaatcaagcctcccaccagaaaggcgatgatttggaacacgagcagaatcccaccaacaatgcacagcttcttggtgctcatgttttctataattgccccagccatttttgcgccccccctttttcttttctccttgaaataaatgttttagggtgagctttttgctccctcctctcacacactccctccttcctcgcctcctttctgggcgctgcaaaacttcagaggtgctggagcgcggcgaggatgggaccgggacggaaggcgcccgcacggattcccccggcgcagccggctcgggttcccccaatgcccggagctgtgattgtggccgctccgccgcctgtggacg

SEQ ID NO: 1081 - DNA, 107244 bp, Homo sapiens
tatgagttttagcaggaggggatatgcatgtacacatatgcatatacatacaggtttatttaaatgattggatctacacttttggaggctatttgaagtatcttatcaaaataaaacgcattttaagcaagaagttaaaaaagcttttcagacccgaaggccatttaatacagtaaatcttacttgggtagtttagcaaacattttttaaaacccacatccaacagattggttagtattagatacacagatttggtttcaaagctgaaatacccctggtggaataaatcttctcatgaaattcagttatattatgccacaaaacagggacacttatctattgacaacttaaatattaactcagtgggctacctggtgatataaataggaaaaaaacagtggtcatggattaggagtgagaagactatgacaccagcctaccttggactgggaccgcaaaggatgttaaaatctatcctagaatttaaaacaggaaaaatgtcaaatattccactccccattcggcccaaaccatcccccaaggaatacacccccaccccacccccacatgaggtttactaaccagctgctacagatgttactatgtcactaattaacaatgatcacagaaaatgtgtcataccagagtttttgttatcatacacaatgcattagtggctgcaggaatcttcctccaaaagctaccgtcagaaggcaaactgacaaatgtccatgccgctggtccaagaaaccacagctaagagccatgaggcattcatttgtacattgagctctctctggcatgctccccactctagttagaggggctggggtatggagagaccgtcccagccgggcgctgcagcctcctactcctgggcctccttgcgggtcaacttgtagatctcagtgggtccgtccacatgggtgatagtggtggtgagctggagttcttccccactatggacacccagatcgcctgaaacagggttttcggtgttagatgcattcaaggaggaaggagaagcaagctggggttcatctcatggacaactgccctgatgctagccctctttgacattctgagcacacagagacacctagggcacacaacattcagaacaaggactaactccaaacctgttcacttggactttgcagaactttttaaaataccatttttggctcctagatgacagtcattaagatacgtgagtcagctcactgctgatattattcatagtaatcattaacatttaatgagcatttactttgtgcctgacgctattctaatcactttgtaagtgatcttctttaatcctcgcagaagccctctgaagtaggcagtatgaacgtgccagccttacagatgaggaagctgggaggtaggcaaggtaattgtcctgggtggaggagcaggcccacaagagagctggcaaaggaacatctgatgccaagaccaatgtgatgggctaaaccagcataacacccctcccaacggatgggtcagtcaggcaccaacacatttgctatgaataatttacaaaataggagccaggtgcagtggctcaggcctgcaatctcagctactcgagaagcaggggtaggaggactgcttgtggccaggagtttaagatcagccttggcaacagagcgagaccctgactctaaaaaaaaaatttgttttaattacctgcgtgcagtaactcacacttgtaacctcagctactcaggaggctgaggcaggaggatcactggagcacaggaattctaggctgcagtgagctatgattgcaccactcactccagcctgggtgacagagtaagactttgactctaaaaaaataaaaaaataaactacaaagcatctatgtcacgtgaaagcaaataagacctgcttatatctatccatagattggggaaggagccatgtctaacacatctaggaacaatgaggggctttattctccaggaaaaaagaagtgccagaaacgtgctgtgcatttccttctgccctcaggattgtcctaagtgttctgaactcattatcagtggacagtgttctgctaaaatggaataatttgaacttttctaaattagtaggagaaaaaaattttctctaagttaaacctcgaaaactctgctacctgccataagacaagtgaatgtataaacaacaaagggaaaatggaaaacgcaaccacgctcagtctgactgtgtgtgggggtgcacgtgtgcacacatgtttgtggagaggggtgctggggaatagaaagttaaacttgtgtcagtgatttttatattgtgcacatatcatatgataagttttctggaactgaagtttttctaatttaaagcatagaattaagtaactaaatgctgttttccattgaaatgccataccataacttagaagcagccttggccctacccttaggactagtaatcttatcactaatttaagaactgctaggcatcaatgaatctggtggccttagaaccccagatgtcactcccacccactggcccagcaggctgcttggctggttcccttcacgtgtgccacgcagtattagtttctcatcgtagacccatttctctgtggctgcacagcaaaatcagtcctattattaaatgccaccctgtaagctctctacccaggagattccctggcctcagaagcagactcattggctgctgcagaggactgctgaagacatttggggctgttttggcaagggtctaatccacaggactatgggtagagaaggcattaaaggggcatcagtccagcctccagcacatccacattcatctgccctcaagccagagcatagatgccaagtaaggctggtgagaggctttagctgggctactttgggccaagctgaaccaccacttgtacagtgagcaactactcccaggccaataacttgtattctcactgctgcaacatctagtccacacctcagtcaagcacaagcagtctaagcttcacatttctcagtcaaagctatttctggatttgcatatctgggctagccatcagaacttcaaagccagtttcatgatctgcatgtctgtgtgagtcatcaaaatttcaaagagtcctgaccaccccagtggacccattagcactcataaccgtttacctaaggaatccctttccctgaggacttcttagaaatagatgctagagagtaattctactcaggctttgaaccaaagatgttaattctttaaacttaaaatatgactccaattagcagatcttagaatatgcatatgatcctacagatcacttgaaaaaacagccaaaattgccttggcttctttatttaaatggatacctatgtcataatgcttaacacgtgcctgacacagttctaaatactgtacaaatattaatgcacttaattctcatagcagtcctcagaggcactattatcatcactcccattctgccgatgaagaaactgaggcacagagaggctaagtaacttgcccaaggcccaagctgctaaatagtgtgtgggattcaaataaataggtgccaggatgcaggctctcaacttttgggttctgctgcctcttcttaaatattcaagtttccagcagccagtgagactgccagtgaggtatgaagtccacacacacagcattacagctaaaaatatccgcatacagccgggtgcggtggctcacatctgtaatcccggcactttgggaggctgacggcggcggatcacttgaggtcaggagtttgaaccagcctggtcaacatggcaaaaccctgtctctactaaaattaaaaaaattaaccgggtgtggtggcgcatgcctgtaagtcccagctactcagtaggctcaggcagaagaatggtttgaacccggaaggcggaggttgcattaagtcaagatcgtgcccttgcactccagcctgggtgagagagtgtctcaaaaactaaacaaaacaaaaaactacacataaaataatttgaataaattgtttagcatatttactttgcttttgtatctgataaatttatagcatataaatcagtgcactgacaggagagctgttataaatttatgagtattggccatatgcactgttaggggtttagcatgccctgtatttccttgtacgatgtgaagctactgtggcataattaatttctctactgtgctggatgaggacccagataatgggactccatgcaccaaaatctatgtttcacatgtgattttattgtaccttgaaggccaactgttcccccttggggaatgggtgtgtgaacgtggcagtaacatagcacgagtggagatccctccacttgcctcctaattccatcacctcctacttctgccaaggtcttgctccatctgttagtttccccctctcttggctcctgctgttcagtgcacaaacatgctcaaaagtctcttcccatctcagacaagaaaaaacccttctgaaaatgtgatatgtgtcttggggtgaaaaagagtgagaaagaaaaaagaaaagaatgctttagtttgcagtaaatttctctccctggttatgatgtcaaattcatcacagctcattaacaattagatgacggtctatttcttcctaaccttgtgaaatgagaccaatctctggcacagatttcatcccaaaggactacggcaatgcatccatatgtgtggagtcacatccacaggtgtgtaagcggctgcttggttgtaactgcctggaatgcctaatgaggatgaagaaagccatatgcactggagacagcttcttaggaccggcagcattttaatgacaattgtttgtgtatctgtgcccacttcaataaaaatgacaacagctactctcattctgaggatgtattacagattccgggagagatcggaggtaccactagaggtcttctaatattaataaggcctacgtacttccatcctcaccactaccaatgcaaattaacaccccactgcccaagtgtgaaagccagggagctcccataccatgagttcatatttgttctcaaggtcatacacaatgtgtgccggagccaagattccaaaccatctgtgtctacctccaaagcttatgttctttccagaacattcatgacctatccttttttgtagaattttccctaggcccacaccaacctctctcctattcaccttcaaagctaagttcaaatgataactttttgtaacgaagtctctggttcacagcagaatgagaaaaacagaaaagtgtagtattttaaagccaaattattttcatgcaaagaactgcttaagaatatgtctgccttacatttttggtgttaatatgattgttatgttaaagaacaaaatagtgtcgctggtgcagtggcttacatctgtaatcccagcactttgggagacagaggcaggaggaccacttgagcccaggagctggagaccagcctgggcaacatagaaagatcttaaccaaaagaaaaaataataataaaatggtgaatggtaggtttcttcttctttttttttttttttttttttttagatggagtcttgctctgtcacccaggctggagtggagtggagcgatctcagcactgcaacctccgcctccagggttcaaagagattctcctgcctcagtttcctgagcagctgggactacaggcgcatgccaccatgcccagctaattttgtgtgtgtgtgtgtgtgtgtgtgtttttaagtagagacagggtttcaccgcattagccaggatggtctcgatctcctgaccttgtgatccacctgccttggactcccaaagtgctgggattacaggcgtgagccaccgcacctggccttttttttttttccaaagaaagtaaatacccaggacagtatgtggtatatagtaagtgctcaaaacacccatgaaagatttgcctggtgcaggcaagggcagttcctctgtactctgcatggctgggtctagcctagcatatcggcactggtgttcttccccactggcatttaggaaaacaccctcagttagaaaacaagtgtgccttgggatagctcagctttgaggatcccttctgggagatggggcagagtggctttggtggacagggttaagagccctgggtccagttgtctctcggtgcctgtcaaccccagaggtcatttattccaggcttggagcgagccattgcccatggacctccaaagcacctcctgacacttactgccaggcagtaactgcaagtgggagaagaacacaatagaacttattagtttgggggtaaaatcttggtgttacaggctgaattgtatctcccccaaactctcaaattcatatattgaagttctaacccctagaacctcagaatgtgactgtgtttagagatagggccttcttaaagaagtaattaagttaacaatgaggtcaattggggatgggccctactccaacagactggtgtcctttgaaagaaaaggagattagaatatagatatacacaaagggaagaccacgtgaagacacagggagaaagtatccatctacaagccagacagagaggtctcggaagaaacccacgttggtgataccttaatatcagactgtgagaaaacaagcttctgttgtttaggacaccctgtctgtagtattcgtatagcaactctagcaaacatttaggaagccgaaggttcttcccaagaaggtaactgagatgtccctatcatggtggggtgacaagaattctaagactcagaaaaaatgattttaattgactgggccaggaaaggtcaggtcactggcacagcaatagccctgggagaggcagggggcagaagacacctgattacaaacagctgagcaaggggtgccaggctggtgacggtccatcagttggttcccaccttcactggggaatgggaaaacgcttttaagacctgctttagggtctgggtccagcccgtgtgacaagaccaatcccatcagtgctcacagacatcaagaagctcagctggccatgggcagatcatctaatgtacaatcagggagatggcgtcaataaaagggggcaaccaatgtcagggcctcaggacttaatccaacgctttaccgaggcaacaaagccaaagccatctttcctatgaaacaaggggcaggagacctcagaaacctccaggagtaaaactgacatcacactgtagctagctgccaagacgcggaaccagtgttgccgcttttgctccccgcagagtgggtgcattagacagaaaatgcttagcgtgaacagaaataggagggaatggtggcagtgagggcatcttgtgttccctctgccacagtcatctagttgggaattctgtgtctcacttctttttttaaaacattctgacaagaattttataatcaaaagaacacaaaaatcaaagctattatcaagaattgtctgacttcataagcagctccaacttcttattcccacctgaattgtggttgagtgggtttgcacagtttttcatgtgtgcagggctttgctgctggagccccgggaggtggtatttttgctctgagaagaggattcactttagcctgctgcaattcatatctgcctgggaagacatccagaatgattcacaaattggttatggcaacaggtaaaaagaacaactgtcatgaaaaggcagcagcagcaacagcaacagcagcagcagcagcagcagggcagaaaatataagtgttccttgaaggaaaggtaactaaaatatctttgctaaatttaaaaatctatatgtgcacgtgtgtgtgtgtacactcagacacatatgcataaaatgattacacatataattctatgtacataaaaataaaatgattaatgtgaatgagtttgcacattcactgccgctatggtccaccagccaataggaaggaacccaggggaagtccacgaaagcctgtggctataaagaatgtggcgccacactcccgcagcacctatctgctggtgagaacactccagtgtggagttgtcctgccacctttcaagaggtagatgaggaaatcttgtcccccagaccaggctaaagaccccttgagagcaaggactatgtctctgtcactccttcgagcttcacttcactccatctcattcaagatggcacaaggctaagtactaaggaactaaggtatgaggtatgagctaagtactgaggtgctccgtggttcatttgtaaagggtcactttctgatccatactatgaaagagaaacagaaatatatgagaaaatgctctttggaaagtgaccttgtcttgaacctgtggcccactttgttcttctctgtccattctatgaccaaaagagagaagaaaaagtctatcgtgaaatgctcaatgattccatttccttcctacccacttctacttcctcctgacacttggcatgtccctccaactcacataccaaacaacctccatcaaagattctttcccttttcttattgcctttggcatcagaaactgcttgtctgtgctccgtccaggatccatctaacaaaggctgaagccccacacacctgggattcactctctgtagcaagatatctgaattcctagctctgaagcttcaaagcaaaggagagaaagaaatagggagggaaaggccaaagccaacttaaagacttcccatgagaatggaaaaggagcatgggaatgctggaggtggagagagaatgccatccagagactcagagaatgtaaagacacatgtatccttccttgcaagagttcttctttgaggtttccacataatattccaaactaggtctttccaaggaacttcgaaatcttggcaaatgctccgtaattcctaggatacatcgtgtgatctggtggcagatgaagagatgaaaagtgaaacaaaatagagaagaaaaataagcagaatgcccaacatggaagagaccccttccaaatgcacaaggtcacagcaccatgcaggaaagggaagggcccacaagctgccaggggttcccgggggtgctgggaaatcacagatcatgttaccaaaggagaactgctaaatcttatgacttttgtgtttaggatcagcatatggtccccaaatagtttgcccactaaattgcctgaagaatgttttttcacagagggtctacttggcatttcacaggcaggacatttctttatgacatgagccttgttttgcctattgaacaacatttagtagcacccctagaatctggacactaaatgccaaaggcatgtcccagttatagtcacaaaccaaaacaactgtgaacatttaaaaacacccacttagcagaggattcaggggatatgacctcttgttgagaattatttgcaagttttccatgaaattacagatcaagctgtctttgatgaaaaactctgttgaggaagagtgaagtgcttttctcaattgcaacatttcaagcctaggagactggctactgtgtagggtgggaagtcctgatgggagctgcctaatatatggctcaaatctcaagaatctgtccaacatggtggtctgtagtcatcctgcctctgcagggttggccacagctctgggctcccacttgctgaacagtgttaaagttggacacgttctcaccagtgtttggaaatcccttacctatgacagatatcactctctgggctgccacttagtggcaagaagtgttcttctgccccttccctgctaataggaagaaagacaaccatggactttcttttcttttcttttcttttcttttgagacagggcctcctctatctatcacccaggttagagtacagtggtacaatcatggcttactgcagcctcaaactccttgggctcaagggatccttctgcctcagcctcctgaatatctgggactacaggtgcacaccaccatgcctggctttttttttttttttttttttttttgtagagatggggtttcactatgttgcctaggctggtctcaaacttctgggctcaagcaatcctccagccttggcctcccaaagtgctaggactataggtgtgagccattgcacccaggctaaccacagaaattcgtagttcaaaaggacttttaggagatcacttacatttgggagcagtggtgcacagagggttaagtgttttgccaacagtcacacagtaaaaacaaccaaaagaatttatgtacataaagtgctgtagcacacagtcagtacttgataattatttcccaccggtattatcattccatcatccaggaagtccagccattgctttaagtggtatttctctggaaggtagaaactctacctactcacatcaaggacaaggccacatggtttccttcagtgtcccccacaggatgaccatggaatgaaatcaagattcttgtccacaagcccagcagtgcttgctgctcgtgttgtggaagcccactgcttgacaggctgaatgctcccattttccacatgtacagtaaaaacaccgagtggtgtttttactagaaatggaaaggaagaaggctgcctagctcacaagccttctagcaaaacagtcagtcaaaccaaagttgggcagggggtaggtaagtaaatattctgtattctcacctcagaccagagatgggcttgaaactgattgtaacatgtctactccaaagaggtcaaggggtgagggaaactcatgtccagcatgctctcgcatggacatggcaaatacaggatgaagacagacagtggctgagaccactccacgtcccttgacccccagcacagatgccttcctctcctgctccacttcatctcatctctcaagtaactacccccctcccttctccccacaagatcactgaaggctaatctagaactcttacttctaagcattaattcactcaatattttaaaagtatcctaaagaactggtccttgccctgaaggagtcgatgatccagcaggagcataaaggcacagatgactcatcttccacctctacacaataaatgtcatgtggaaagtagactcatgatcccctaggcatattccttaggacaacagtttcaagagatacactgcctaaagaaagggtgccagggccaaatgatctaataattctggaaaatgctgttaccaccccccgctttgtaaagactgacagtacaaattaatgtactaaaggcattaacatgtattgcagtgaaaagccttattagtgctgatcaactcaatcattctcaagcatgtttgactacctaaatttatcaacatttcatggagacaatattccattgaatgtcatttgctggattctaattggggtgattgggaataggtgttaaagaagatgctgcattttgactgggcccaaaagatgagtagagtttcattagtcccagatggaggcagaatgtgcaatccactcatgcaacacacactcactgagtacttcctaaaggtgaggccaacccttggctctggggggctgctaccctggtttccactgcaaggcagagtgaaaggcactagagcactgatttgagaaagggcttcctatgtttggggaatagcaaatgcatggctagagtaaagcaggtgtaaaaagagacagaatgaggaataaggctgaaccaaacagaaaaagcatctattagatcagttgtttatcaggccacctgttacctgttaacagcactggcctagacagtgttaatcatttctgtctgctgtggctagtgaagaaaccctgagcaagatcttcccttctctaggcctcagtttctttatctataaaatgactggattctctaaggctacttgcagcatccatgtctcagtgttctgtgattataagatataaaaaggcagcagcacataccagcactaaaggacaggaagaactggggacaggagaatagctattggtttagacatacatcgaaaaatcaccttgaagaaaaatgagcagaagaaaaatgaagcctattccatcttcagctctcagggcccagactccctccacctgatatcttaggattctgcttctcaaatgggaagaataaacatggcatagtttccaacagtcaattgtgctcaaaaatgtaaagaagaaaatttgactcttgttctaaaatcaagacatattttagacttagcatgcaatattctcaatgtattttagagatttaaaaatgaggacttaaagaaagatctggcttgtgtgggctttttgtcttatgggtgagtcccctgggtgctcattcaccgtctcccagtgtgaggagtatacttggagggaaagtttcactgggcatctcagagctttagccatttaaatcttgtaaagacagaagcctatttatcctgacttaagctgttctaaagagacagaaactcaccattggactggtcttctccatagtttttatgggatggtgcatacaagaacatcagagcaaagacatacagattccacatcccatagatgcctgtgaaaaaggcactgttcacttggactgtgacgccgccccatttccaatggccttccgttacctgcggagaaaggatggtgatattcaattgaaacagagaagaaacagaagaaacataacaccaataaaggaaccaaccaacatgaaaaccaagtctcttctacatgtgggaaacatgaagggccatgtaagactccatcttttaatctgaatcatttcggtgtaaattaaggtcaactgaaggttctctagctttctgtcaggcacagtcagtggtccttaccttgcccacagattagtatcacctggggagtgtctcttcctaaaaacagcaattcattgctatccctaagttaaacaaactgtgtttgagcccatcacttattcacaattataattcctcctctgctgtctgtcttcccagctagatgtcaattccctgcaggcagagaccagttctctgctgccatgtctttaaggcctgatgcaccatagattaattcaaatccagtgtctaccactcactcggcttaatgtaagacaagatgaagactccagacttcagaacttcagtgtccgtaagtgtaacataaaagcttgcaggttatcgaagagaattaagtaaaaatatttctagaacctgcctggcaggtactcagtaaatattagttatttctataacatcccttgaagtaagccactcatgaaaataattatgaagctttcatatgcttcaaaattctgcaagagatgttttgaagctgcttttgtctgtgttaatgatttggtaattgtcttaagggctgcctaaagatatatggattacactaagaactgtcaacagagctgctgagctaagtgactaatttgtgccagctctgagacaaatgaaatgattttgaccacttctgcttactacgggacacttaaaatggaaatagaagaaagtattgggtaaatattcctttgacagctgaatgaggctgcgttgtataaactttctctaggaatcacttttaaattgtaagatggcaggctagattgaaatgttaagaactttaacaagcaggtggatttcattgcctgtttatgatacagtgggtctgtgttcattatcttctgtataatccataacccacttggggccctaggccaaattaaggtctaagtataggtatttttttctgaaagaccaggagtgtcagttaaccacattagccaattatagacttagcagttttagtttggccttggtgatacataattcttcactttttgtgactcataaacaaaccactattatgaactcttatttattttggaaaataatgcattttatataaaatgcccagaagtgttttctggcaaagatggatttcataaccattactaattttaggacaatgtaccagcattcaagctacttaggacttcttagaaatgtctccaaatgtcgctcttctttaagtgcagaatatactaactttataaaaactatattacttagagcatcttatgatgatttttattgcatataatggaaaggaaaagaaagcattaagatagtttccagaaatacaggtacctgctgtcataacacagagaactcttctgtatgtgattaaggaggggaggctaggctgtcacgcatcctagctgcaagagagaatatggcaatatggcagctcttctactctgttaaggcagtggacccttcagctcagggaagggccagtaagagaccctattcctgcgacagaagctggaaatactcaatattgacaattttagtgacattgattcttgctaggattgacatgactgacccatctaaggaaacaccaacctatgtgccttgcacacagtggtgctcgatagacatatgttgaatgaacagaggtaaagtacaggtatgtgtagggactccaggacaaatacatggaggtagaaagtggagatggaaagaaccactcttaaaagtacttgattgaaaagtaaagacaaagtattgcagtccacaagtcataataattgaatttaaaagtgagaggagatgccaatgtgtgacaagtgttattcatttaaaacattgctttccgttatacttatttaaaataagtggttaacacaaatattagcaaagctaagattcttttgtattcataacaaggataagcatatttattcaatgctaatgatgtgccagatacaatactaaatccttttacatgaaacacattatttagtcttattaatgacgctgtgaggtaggtaggtaatatttccattcaacacatgggtaaactgtggcacagaaagatggagtatcttgcccaagattgctcagccagaaagccatggctctgactccaaaagaaggtattcttaaccattatacaacacaagggtaggaatgctatcttaaacaggggttgatctctgaaggtagcacatgctctgaaggtagcacatgaggcaacgactatgtaaggtcaaatttccttttgaaattcacttcattgcccataatgtacattacaaatacaacatacatgcacacatttgtctattcaaatctgtatagtatgcactatatatcctggacatagtaacatatggtataaactggatatataaacaaaataaaaacttacagtagaaccactggaatgagatgcccatagtatgagaggcacacaccaagcctgacaggaaatatcagactcatgctcccgtctcgtacttgctctgggacacatgcacattgtttagagtggagttgcagaattacacaccctactgaatgtgcaatctgtaaatgtggtgtttcctgctgtgggcaaagagttgaactgcagaaataaacggtatagatagtgtaactctgctctttggtggctggcttgtttttccctctcctctcccaattattcatgcctaagacatcctcagctctgagcacattcccaccaatatgtaccacaatgagcagcctcaacagagcaggccttgtaaatccaaaatcttactaatgccaaggcggaggtaacagtctccccccttttaactttgagagaaaaatcaggtagccccagcccccctccgccaaaccctcccccctcctcaaaatccccaaatctcaccctctgcataagtcttatttctaaaagtccctgtttttcctgattttacatttgaacaatttacttttgtgtgaaaccacccaattatacccctggagccaagtgaaggtcaaatctctttacacccagtagtcttgacaaccaacattccacttaacaacaagatttccaaatcccagacacaggctctcttaccggaaacatttcctctgtaagtaacagaatgaagtgatcacacacacacaaaagagctggggacaggctctctgggagtttgctgcatgtggcttgacctgaatgtcaggcacctgggggtccccttaatgaaggtcggtgaccttctcccctgcactgcacttctgttccctactgccgccacctctaaatggaacgcctctttcttttccagagggaaggggctgaaataccagactgcgatgtaccatctcttggttgctatgactgaggccattaaaatggcaggcattaaaagactgcacctcagtacccagctacaaagcctcaaggtcactgcattccacagcttcccgtcgcctttcattcctggcctcagagcttcaatatcctggcgagatcccctcgcattatatttcatgaggcttaaatgcaagctctcccacagcaagcccgagagtataatgggggttttaatacattccttttacctaaggctgggatccatttcaaaaagttacccaataggtttcctttcaggtgagctcattgctctgacattccaaaatgacattaaaaaataaatcctctgatgactatattaatacagtacctgggacactgagagttatgccggaaaacgtcttagatgtctataaataaatcttagaaaaaaaacccagcaggaggaatgtgaggagctaatggaattcaaaaggcctcattgctacccccttagagttgaaatccactccgggccgactgtcgcagcagatataaaaagccagccacaggctgaagctgtattagaaaatactgaggcaatagaatattaatctttttctccaaagaaaagccacggactatgctccttggaagatggcttcctttgctataagaagtacactaattaaacatgtacaaggttaaatcctggcaacatgcagctgcttcagggatcagtccttcttgacttcaggtgggaggcattccccgcagaggcaagatatacatgaggcagtgtggggagaatgacgtcagcctcccaaactggcacaaggacctgtgtgtggccttaggatcaaaagcgtccttctttctgctttcctaaaaacatatcttgaaattgccttttatgcctcaacccatcttccttgagatgccgtttctccaaggaagtgctctgtgccctctcagccttgcaggtctggctgtgtcaagtgccactgtgcactactgagggactggaggaactgaaaagcattttggtcataggagggaatagccacgggagaagtcaggcctcagacactcttgtttgaatatggatgtttgagccttagctggtagaataaaacactctttcagagtttgaaatagttttactgcaaatggagtggaaagcgaagtttccaaggttttataaacaacctgatataaacacagcagtgttgtaggtcaaagcagatgtggtgaacagaacttacaaagacatatatgtgtatcagtttattttttccacgttcatttcaacctcagcagagctagcaacactaacactccccagtggcagagccaacaacagggctctagaggctccaaacttggggtcctcttgggtgtccttggatagaattcaaggggtccataaactagaatagaaaaaattatatattttcactagtctctagctgaaagataatgtttacttcaattatggatgtagaaaaatccctatagtgttagtactactgtgattttctcaatagaaatcatgatattttcacatcaattacagttgtagatataaatctgtaatatacctgtagcatctgtttcactgtaaatatatattacatataatatatagagatgattccccttgaaattcgaagtattttattttacttatttgaaaccattctaagaggagactcgtagccttcttcaggttgctaaaggggtccatatacaaaaatggttaggagtccctgtactagggaaacttcccagcagaatggagcaagtcgtgtcctaagacactatctacactactgaaatcctccattttggctaaatgacaaagcactggcaaaagagtcagaaggactgcgttctgatctctaacttattgcatgtcctttggcaagaaagacattcaagcttcttgctattcataagaacacagctactcatgcttacaatgtgccaggtgctctgctaactacatttggttgccacaatgatggttcagtcaacaacagaccacatgtatgacagtggtcctgtaagattataatatcatatttttactgtatttttctatgtttagatatgtttgaaatacacaaatacttaccattgtgttacaattgcctacagtagtcagtagaggaacatgctgtacaggtttgtagcctaggagcaataggttacaccatatggcctaggtatgtagtaagctataccatctaggtttgtgtaagtacactctatgatgttcccttaatgaggaactcacataatgatgcgtttctcagaatgcatccctctttgtaaatattacttcctgtagtcattacagcaaccttctgtggttctattgtaatatttattttgcagataagaaaattaaaccttagaactgttaagtaatccatccacagtcctatccagctaggaagcaacataaatgaaaactttctccaaagctattagatatcatagtctagcaagctaggataacaattcctgccctacttacctcgtaggatttttgtgatgctcaaatgaataatagatacattagatttaaacagtacttcccacccttcaaaacaagttatgaatattttaaaatgattgttattgagattttcaagtatagcaaaatgttgagttttggaaataaccagtgaaaagacaagatgctatcaaagagacttttgaattacatttcatatttaagtggcaatataattattacaaggaatagctgatggactgtataaggatctatgttaatgctagataaaaatggaatcaaatttatgcttgttagtgttgtgctacacggcttgataagtttttctcataagtaaataaaatatgtgcccttcaatctggctgtaggcttttaatttatttggaaacttttatctcctacaaggttttacggaaagagaaaatttagtccatttggccaggtgatatcaagacccagaaaaatatggcttgaccagctgtccagaattatggcctctctcctcctttcctcagtggctctattgaatttctgtgcagggtagagggatctctgcagagacattctcaccttgacatctcagggtccacttacctgactaacgatgaagaagatgacagtcatggcagcgcaggccaaggtgataagcatgaggaacttgaacctaaaaattagcccctattagaaaagaaagagtagtttaatactccatcagctaccaatccttttctcactatgtaaatctataaaaagcttaattttaaagaaatctgtaaaaccaaatccctaagaatgacagtaaaatagtttcccatagtaatatttcttctgcagaggtgagtgtggctgaaaatttcttgggccaagtatttcctatgttcttatcactcataaagcagcgatacgagagcctgggaaattatattcacaacacgtcgtgaggctgctaatttccctgctaagctggttatgcttctctgcaagggttcaaagttaccaaatccaagttttctgtggttgtaataaaattctgctccagtgaacaaaaagaaatgtgcatattaatcaacatgaagtggatttggttgaattttctcatgtcactccagctctggagacaggcaagccttagaaagtgcctgtggtttcctaagagcaggatttaagagaacctgtgtttcagagagggaggcctattattcaggggctcttctgtgcagatctactgcatataaaaactctgaggttctgtagtttctgcttctcttttcatacaggaattaggcttgtttctccaaggacagccacttaggcatgaacccaggggatccctgataaatcaaggatgtgttgcttgcattggggatttgaggatgttaagtgtttctcttgaatgaggaacataatctataaacagagattactgaactctgtctgagcatctgctggatattttaggggaatgtggcctgttaagagtctggaaatcagatcacgtgggctaaaccctgtttaattacaggacagggttgattctgggacagaactttgactaaagcctcatcccaacaaaatcccaattatgccatagtccaatctcccagctagtatgtaacctacattccatcaccaagctgaagaaccggctgaacaagtttattcattactgaaaatggaaacacatttgtaccacagaaaacaccaagatttaggccagctagatgcttctcagagtaagatttggcctctaattttgcccagagatcctacatgagaatctctcaatttgtatttcaaagtaaaggctttctatctccagggtgtgtgtgtttacacatcaagtggaaagatcaagcaagcaccagttccagaacgagccaagaaatctgcccacctcatagtgtagccgccggactttgctcatagctggcaggctggactgcttcccactgatgttccgaaacacctgaaataccatgaagcatagaaacaggaagtagaggcagaggcagattccagccacgatgatgaaggccatctggtcgtgtccagtaaaggaaacaacgggctagccaaggccaagttgagccgggtccaggcccttctccccaggtctgttggcaatacttgttttgtctccaaatatgtagaaaattttcaaggggataaaatattaaaacctgatattctaatgccaatgataggtttcttgacacattagtaccacagagggaggtgttcaatattgctttctaaaccaagtaagaaaagaaatggtgtcttgcttgttagaaatgaagaatctaggccctaccctagacctaatgaatcagaatctaccttttaaccaggtccccaggagatccgtatacacaataaatttgagaagcactaataaaccatatattcgtcactatggatcagatgaaaaaccacagtaaaatcaccagaagggttcaaatgtagatccccaggtccctccctagatatatggaatcagatattccagggctaggacatcaagtatgactatgtttgggaaccactgggctagtccttggagttttataagaatgcgattgagatactctggcataattgaagaggagatacgtgggggctcagtgcaggggacctgggcatgggcttgaaagtcttaaagtgaaaccagggatgaaggactatttgcaatcttctgtcaccacagaaaatcttgtccaacagaatggggattcaaggacacatggcacaggtgggagtctgggttgctgccagtatacttgagacccactagggagactgacctgccaattagagccagtctgagaaccaccaagtcttaggatagcgtgagctgccttggaaggcagatgacctgattccaacccctttctgctacaactttgcccaaattgcctttttttttttgagacagagttttgcttttgttgcccgggctgaagtgcgatggcacaatcttggctcaccacaacctcctcctcccaggttcaagcgattctcctgcctcagcctcccgagtagctgggattacagggataagccaccacacctggcccaaattgtctatttttaaaagcatttaataagtatgaacttggcgtgcatatttcattaaataatataatatctaatgcagtttctccttctttcctataatgaacatcatcctggaatgaagggaatatagttattttctgcaggacttgaaattttactcactccatcctatctacaaaattaaaaaagttgaactagatttaacattagaaacattcttcttgttgtgcagctaacatttggtgggggcataacagaggaagggtagagcttctctctcatctttgaggaaatgatactactgatttagtttgctcacaatgttcttgtgacactgagaaaccaatataaacatcatggcaagacaaaggatattccctagcacgtggcaagatatgagccatcaaggaagaatacaacccaagcctttctctccactccagagcagagtctttttctcccaagatcatttcacatactattccggaagataaaatatttaaatccagcatcctaaaagggataagctaagactgtcacttctgcttcatgaagatgacttagagtttatgccaaccaaccagaagccttggcgacttctctggaactaatcaccttagccttatctccacttggtctcaggaataaatagcagcagtgtgatttgccagcacaccaaggtcacttaagaagtctcacacataggtggtttcagaaacaggctcttccacaggggcccagagatgaacctccatggctccagggaaaagctagtcatgcttcagtctgcaggaaacagtgtataacagataattcagacaggctgcagtaagcctagcaactcggatccctctgctgtgaggataggctgtgaccttctcattttgcctgctctcacccaggcttgaaagcaagcagtaattcttcttattattagccttaattgtgctgttatgattggcctgagaatcaaagccctggctgagtacatatggggagcatcagcagagccttagaaaatgatcttggggactgggtggccaggggaagaaataaaaccctgagcccatcaaggaaggatacggccagctctgttccaatgtctgtagtccagatactgtagaagggattcgtgagttgtacccctctacaaagaaaatgagatggaaaggcaagacacaattaatacaaaggcaacgggaactttccttttcacatattcttagcttttcagctgcaggggtgagggctgtatttaggctaaaaaacattacagaaatcctaaagagaaatgaagcttgtagaatacatcggcccaaatatttttcaactgtaaagagctgtgcctttgatttgatcccagaccttgtctgaggatgtgaccacgtccagtgcttccaaaccaaaggttcccgaccaccattctccttttcaaacactcctcctaaaatgacaggagtgggcgtggtgatgcacagtttggctcagtgtcccacaaacacttgctcacctctcacacatgtcaaatatgaagaggcagaaggagccaacggcaatgggtccgacttgcttccaataccctgcgatgtggttccgctcgtgctgatcctgaggaaaaccaaattgagaagggagatagaggggagaggaagaccaagcaattctatgggggagtcagcattcgaaggacacttgccgaccacctattgtgtatcaagcactatgctagattctaggtatgagaacaaagaagatgaaaatctcttcttcaggagctcatctctgtgggggagtctggcacatacgtagaacatgacaaagcccagccataagggctctgagagtaataagaacaggatgccatgggaacacaaagaaaggcctcggctcccaggcaggggacattttgtggtccacaaaataactcattctgaattaaatttctacgtgacttgtaacttgtgtttataaaagtgactgatcctcagaagacaaagtaaagacattaaagcatttaaatatgtaaagtgtgtctattatggtgaggaaaataggcatattttctccccatccttattaaaaccaggaatgagtccccttgataaacaaagacaccaagagaaagaaaaggaaggaatgtagaatgagaaaaaagggaaagcaaagatgatcttagcctccaggtggggccccaggtgggtcagtccacaccagctccctgcggacaatccttggctggcttcctggtgctggaccaagttccatccactcccccgccctgctgctgaggcctcattctcagcgcatctctgctggaggacacctcatggagaaagaccccttaatgtagacagtttagcagtaggaagaagtctctctctctgctctcacactgctctcctggaagggcagcaggacttgagaggtctggttttcatgattgagccataatggaatttaaaaacagtccactctgctgtgaagcccatgtgcctgacgtgaagaccaagttccagctggcatatcatcttagccacaatgtgatgatgacaccattcttatttttaaccatggtaccttcaatccctcttgaaatatgatttggtgtctgtgcaaactgaggagaccgggaaggtctgtatttcagagtaataggggttactaggccacctggacacattgccagctggaaagagccaggcccacattctctgatggttaacctgtattcctggggacaggacaagcagggcagaagccagcagacaagaaactcaagctcaagggcaagaaataatactaatcattagaatgtgtgtgtttatcttaagttactcacattctgtcatttaattctcatgaaaaccccatgcagtaggtctttacatcccattttatagatgagggacccgagattcagagtgataatgtcatttgcctaaagccactcagctggtcagcaggtggtgaagcaggaatgtgaaccagagggtctgcctccagagttcccacttgtaactactagtttattctgtctcacccactgctgactagaggcaaaggggggcaggtgtcagcttggcagcctgcacagagcagctggtacagacgtctgtccctcccggcggctcttaccatcatgtgctcgccacagaagatgatccagaaggacagaagcatcgcatagaagatgccctgtcggatgtcaccaaacagcagcatccaggtccagtcaaacccgatggaaaaccattccactgggatattgataaaggtcatggaaatcccaagggcaaagatgactctgatggtgagaaaatatcaggacagccactttattcatctggaaggcagattttcaaacaattccccgaattcagttttgagacatgagatgttacttattgggtctgaagccatatgatcaatttcttctgcacagagatgcaaaacgtcctatgtagttggcactgctgcagaatgagggagtgctataccaacctttctatggaagtgaacctgacctccttaatgcctcacactttactttggtaccactgcagatggcagtcttcctataatgtttgtgtccccttgccttctcacccaggcctcagtgagtacaattgtcctctttcacctattcaggttatcattcatctgatcattaagaacactcattattattgtgatatcctcagcaactatgaattatataagcatatttgtttcaataatacatgactccaaacacatttgaaatgtaaattctcttgactgcttgtttagcttttattttactcttcccctgtcacactaagaactgccaattctctactaaaatataattcttaagtcactgatttattcatacttttttccatccccttgaaacacatatgttaattaagcacagatcatgtaccaggtattgtgttagcactatggaatcctaaatgaacaggacctgttttttcactcacgggagatacagttagtagaggagccagataaagagacaactgaatagattaggatcaggaacatcatagagttttaaagcatagagggctgctaccaggacttctgactttgacacagacaggaatggagctgacttgtgagtcaaagtgagggaagtggaaagggtgtttggaggagagggcagagcctggatggaggcatagaggcctggaagaacctgctgcatttggggatctgcatgtggcacatcaggaaatgacaggacatgagaccagagaaacaaagagggctgtgctcatgaagaaacttgcataccccactggagaactgaaatttatcttgaagagactttttattggaatccaataaaaagtttaaacaatggagtgacatgattcattcaaaaaatatttattaaactcctactatgtgtcagtcactattctaagatgctgggaatataactgtgaacaagaaaagcaaggattgtgctcttgtgatgcttgcatagagatggaatgagagagggagtacaagaaaaagataataaatgaagaatgagcatcatgaaaaaaaaagctaggcaagagagtggagagcaatggggatgtgattttacgtaaggtggacagacgaagagatcagcaggtgtgaaggccctggggtgtgggtttgagcacaataaagggggctggtgggtggtggagaggacaagtgacaagatcagaggtggaaggcacccaatcatcaaggggcttataggtcagggcaaaggagatgaaaagccagtggagagctttgagcagaggggtgacaggatctgattaacacttgaaagggggcactcctggctatcctgtgaataggctgcagggaggcacgtgatggaagcaaggaaaggggttgcgaggctgttcccactgatccaggtgagaagcgatggttggttagttagattagggtggcagcagtggaattggtgagatttcctggtgaggttgatgagaagtgtgaaaaacagagacatacaggatgactcactgctacatttccagtctgaacaactgaaaggatggagttgccttttactgaaatggggatcctgggagggaataggttggaaatgggacacaatcaagtgttgttcttggtacatgtgacattttcaatgcaaatgaagacattaagtaaagagctggaatatttgggtccagagttgggagaggctgaggctaaagatacagattaagagtcatcagagaatagatgatttttcagaccacaaaggtaggtgaaatcaacccccctagggaaagcacagctaataaagagaagaggtccaaagcaggtgccccagtcccaaagtctaagagtctggaaagatggaaggagacaggaatggaatctaaatgctggtcagcaaagaagaatgaccaacagaagggtagaggagactctgggaagaaaaactgatcaattatgtcagatgctgggatgaataaaaaaaaagtgaggaacaaaaaatgacctttggatttggactatgaaggttgttggtgatcccgtgaaaagcagttttagtagagtggtggagatgaatccagactggaaaggactcaagagagaacagaggagaagacatatgcacaaggtttttgagaagcattgctgtaaagaggagcagaaaaagggtatgtggcttcagggggaagtgggaaatgggagaattttgtctaagaatgggagatggcaggacatgtttgtatattaatagaatccagcagaaagggagaagtcaatgatgtggagagaaagtaggtacatctacaggagcactgtctttctgtaagtgagaggagctgggcttaggggagtttcttcactacaacacagacaagtatctgattctgaccacggaatatcccgaagagcaaagacaggttaaagaaccagaaaggtcagctgggtgtggtggctcacacctgtaatcccagcactttgggaagctgaagcgggcaaatcacttgagctcaggatttcgagatcagcctgggcaacatagggaaaccctgtctctacaaaaaatacaaaaaactagctgggaagcatacacctgtggttctagctaccgggaggctgaggtgggatgaccactggagcctggaaagtcaaggctgcagcaagctgagatcccagcactgcactccagcctggacaacagagtgagaccttgtctccaaaaaataaattaattaattaaaaagagccagaaaggtgagagaggtagaaccccgaggatttacttaataacaacttgcataggaaaactgcaggagaaaaaggagtccaggatgactcctggtcaaatcactggcctaagtcacacactggctgcttgaactggacaccagcaaaagcaagagcttggcagatcatgagaagccagtattcctgaagagcgctccaaaaccagctcttacttttccagaagcactgggggtcgggacatcatggtgatcctcctccaataccacaccataatgatgaagatgctgggcgtaaggaaggtcttcatggcaaaccacaccttggtgaagcctccattttggtggatcccctaggcagagaccagtgataattttgaaggtgaatattatcttagcatttccttctactagcaaatgcttttgtgggagaggtaagtggagacctcgtctgcgaatgttcacgatcaagagctttcacattcatagcaggtactgccctcatacacccttggactctcctcagagataatagaaatacatattaaaagagccctgtgctatggacctgagaccagagaaataaagagggcatcccattcacaataacggctttcatgttctggggtctgaaagaagaacatggggctttggggcagggtcactatttccaagagacttcgaattatcttaccttggactcatcccactgatattaaaatgctaatacctaaagatacactttagaggtacggattaatagggcaggtatggattaatagggcatacagggtgtatgatatctacccagctaccacccccacagtgtaccccccaaaaaagccacatttgaggtagaaccagaaatttcaggtaaaaagcagagatatcctctatctcttaacacctctcttggccgtttaatcctcattctaccctcacatcttactaatctggtctactaaggctacaagagctttttccctatgctaagattacgattaagtacatgatcaattttttttgtaagcttttcattagaaagttgcagatatcctagatggtcaatatgttgagattggtaagtgttaaggtaaatctattctataaaatgctaatcaatattggaaagtatatttatattacattcaccaatttatattacatataccattaaataaagaaagcaaggaaaacagtcagttcaatatgatcctactttttgtaagggaattactacgtataaaaaaaagcctggaaggagatatatcaaaacctgaacagtgattatttctctaaatagtaggacattacaggtaattattatgcttttctgtgtctctacacaattcttgtgggactttgttgagattgaaaagaaatggcctccttgcagcaagttctaacttttccccaattaaacaaatatgatggaaagaacctaaaccacccctattccttttaacatttgtgcttgcaaggtgaaacacataaaaaagaaaatttacttttatctcagtgttattcattatgcaatcatgactatttcatgatcttatcatcattgtaatgatcttaagtgatcttaagcccatttaaaatcttaagtgggcacaataattgcattgtttcccatttctgtaatctctcacacaaattagttcactttatgatctcagccatcatgagtatgttattattcccatttctcagatgagacaggtgaggcatagaggtgccaagagtgagatggagttcccctccaatacacatgtcaagatcaattacattcacttaccaccaaccggatatcctttatctccccaattcccacattgattttcttcttctcattcacaggcagccggatgtttaaaaggtaaaacttatgggccacagacccaatttccatgaaaggaaggacatcacattcatagtaacggccctcatgctctggagtctggaaaaagagcagagggtttgaggcagggtcactatttccaatagactggctctgaattctgttaccctggatccataacatcaattgtaagcagctaatgcttaaaggtacactttagacgtacagagtaacaatgcatactggaggcatggcgtctacccagctatcccaacctaaaacaaacatcaacaacaacaacaacaaaaaacagctgtattcaaggtagaaccagaaattttaggtagaaagcagagataccttccttctatctcctaacacctttctaggctgtttaatcttcattagaacctcgcatcttacgaatcttgtctgccagggctacaagagtttttatctgcagtgtgttgtcagggtcctctaaggctctgtggaacagtcagcttcttaaacgttcaggtggaagctcttgctgaatcattacactctttaatgacggctaattattctcctgattttggcctgagggagaagctagaagaagctgaaaatatcttctttttattcacttgccaggaaaaaaaaagacacaaggagccgttggtatttagggaaggtcgaaacagaagaaagaaagataataagattagtggccagagatacccactaagaattttctgcctccggtgcttcctaacagtccaagatggcagaagggaatagaagttttaatgaaataagaatttagcccagtgtctaggaaagcctcttggacttcgtgccaaacaatttaagagatactgcccagagcacggtggtgggaaattggacagtagggagacaccttttttttgaaaactaaattctgctccacctcaccaggactcccggctgtgtacctgctgaggggtgggggccaggggtaaagatgagcataaagaggcatgagcttcagcaggccgggacttttccctgatatagaagatgagagtctaccatcaatgttgggtttctatgtcagcttcaatgtttccttggcacctcctgatcaagtgataggggagatctaatttgtcgttcctaagcctgaatttgcaagacctccataatttgtcataaatcttcagagcaaagatccactgaagaagtgagaagaaagaagataacaaagagtccatagtctaagagtatgtaggaaggggctaggaaggggctctgccccttctgagatcttggctggtggggagggttccttactgaacagtcagagcttagaatgcagtaaacagacctttgtacagagacagagacacacacggcaaggtagaggtggggaggtgcttctacctcctcttgcccaccacggcacacataaccaatcagtcgtcaacagtttttatccctaaggtgtgagcagctcttgtcagacacaccagttgattagagttggcatgtgagatttttaaaaattcttctgtagaaagaatgctgctttttcaaacctcagctgcaggtcagatgattcttcctatatagatcatctttctctcccctccactcctttctctcttatactttcaaatcagggaggatgggggctctgcaggtactactaaaagttcactgcaggctctaattctccctcagattaagctgcagtgaggaggctgattatcctctgtggtaacagcaagagggtattttctgatttgtttccagttagggccttattttattgatggaaattgagaacttgagggcggaagggaacaaaacctacttagtctaattccatctggtgtgtgtctcgcccagggtcccaaaagtagtagcagaattgggagaaggacatgggccctgcccaaaggcaggcattgtgctgtgataaagactcctgaactccaggccaggaggctgattctagtcctgaccatgttccttgctgggtaccttgggtcaccctgcctcatttggcctcagtttcctcctaagtgagaaagttaagtaagatgatctccagggtcacttctaatcccccacgatgggtctctgggtgccccacacttccctgtcactactgagtgagtaacatggacacccttgacacaaatttacctaagttcaaattaaaagagacacattggcatctgggacactggctcaaccttcctgtctcagagacaagttcgttgtatcctgttagagacttttcttcatgcactaaagtcctgcctctgccagtatttagggcatttaagaagattcctctctctccttcctttgccccacccccagttctcccccaactccagcatgagactagctcattaggacaaattacagcaggtggcaacttgacttttttttttttaacttcacaatccaccagggactcaaaagctttaaagcaatttctcatttaatcttgagactcaagactaaatttcactgcaatcaaaaagcagagacttgatgattcatttccttcgcacttttcaagatttaatatctttcttgcaagggatcaacacatcctaaagataattaagcattaagaagcagttgcaggcaaacacccttccccctcgctactcagtgccctccatgtgtataaatgagaaatgacttttcccttttctatggataaaattctgtatccgaaagccatctagcttagatgttcaaccagtatttcaaagatgcagtcaacttgcagagatagctagaaaggtttttaattttcttggttgcatgcaaagatctgaaaatgttagctgttcctctctcctgcttcctctagtttgtctatcattcatttctacctacaaatggctttctctggaggacagccctatatttagcactcagcagagggtctagggcagtggctctcaaacttcatagagtttaataaactgaaggcctgttaaaacacagattccttgctcctacaccctgagacattgacttaataggttctgggtgtgccctgggaatctgcctttcctaaaacctctcaggtgatgctgccactgttggttctcagaacacattttctgtagctttgttctaggaaacctgcgggagggagactcccctagtgtttcaaaaaacactgcaatgggtacttaggtttacccatggagggccttagtttatatgttttctcctagtggcccatctggttaatatccgctttgactctcaaatatgtcccagacaagatgttaaattagaaggtcatcctgcctacgtcattgtatcatctagtccaggggtgtccaatcttttggcttctctgggccaaaccggaaggaggagaattgtcttgagccacacataaaatacactaataatagctgatgagctaaaaaaaaaaaaaatcacaaaaagaaattataatgttttaagaaagtaatgaatttacattgggccacattcaaagccgtcctgggctgcatgcggcccgcaggcagagttggacaagcttgatctagcccttaaacagactcccaaggtaggtactcttatctcatcttgcagaagaaaaactgaagctcagacagattatgtaagcttacctgaggtcacaccgtcagtgataaaaccacctaatctttctcctctttaggaaaaaaatggctaaagctggggcaaggtactcagaggcttcaacctcatgtttttactattttgcaggaaatcttaacagtaataggcaaaagcaaagttaggaaaggcccgtggcaggagagaagaggaaataaaatgctccgcagagcaggtattaccaaagctgtcctcatgcgaagaagggacacacctatgaaaagtaagcaaatctttccacatacctgagaaccaaataaaaactgtcagcttagacagcaaggggtcataccttgggagatgtgaaggtgcatttgagtttccgtggtactctttcatgggccatttcagtccactcagcaaacgcgtcatcacggtaagccagggaaacgtccatggagacttctgcattttctcctgcaagagaaaggatgcacgtttcagaaatgacttttggaaagatattttagaaacagctcaaaaaattcttataggctttgacttggaaaccaacgagacaaaagggaaatattaatttctatcaaactccaaacctgaagacttagaagtcataggatgaaagtctaagccaaatgctgggtcccctctcatgtccactctgccagagtcaagagcctccatttaaactcttccagagacaggggcctcactctctctgagggagcacaaatggtcagacctcatcctcccataacttgtaccatgggtcctaggtctgcctgtagaagccacgtggaaggtgatgtccttccttcttccataaaaagtgccttatgttcttgaaaaccataccacatctgcctgcattctctttcctctctgataaacatgaccaagtttttcaaccacctctcagacacgtccctctggggctcttctctggtcacactctgtctgaaaacatccttctcaaacttattcccgaaagttctcaaatataggatttgctacttttccaaaagtcaaaatcccttcatattgtggatgaagttaatgtaaaaggcaaagtgtttttccaaaattaaagacttatacacagataggaataatacataattgcacaaatgaatgttcacacatacttccatatgtgtggactggaccacgaatgagttaaactcaccacagaactcattaaggagatgagattaataaaacattgcacctattaattttgtctgttttatactatgatgagcaagttcaagagcagagaagtcttttttttttttttttttttttgagtataaaggtttaattctatttaaaaagaaagtccattaaatcaacttcaagttcttaactcatgggactattttggaacacttctttgtaaatatcattttgttaggttattggcaaaacagtttcaaggttcacttccctcccttgaaccaggtccaggtcattttgctttggggtaaattaaaatcagaattctaaaagttgagcaactttgtttttttttaattgacttagctctaacccaccattacaacttaaggacggcatgacttgataatgatggacttgtgtgaggttttgagttttcaattaaactttgtatcacatgaggtaattgtcagcattcttgagtctggttatggaataggcagatagaaccctgtagtaacaagagttggaaattggctaattgacaacgcacttgccttaaacatctcaagtagagaacttttacattagtgagatgtacttgaatttcagaactcaacaaattttaattactttttactgaaaactgcagtgaatgctaaatgtctacgtttacaataaacaaatacagtaacagtaactcacactgaaacaaaacatacttctgatagccattatttttctgcttgggacaattttaaagtttttcttttgtcacaaaaacaggaatgtatccaaacaaaggctcaaaagaggccatcttttcaaacaaaaaggcaatgattcacaaaagactgtgaatagaacatgtaactagttgatacaaatctaataggatttgttaaaatcagtcacatctaatacatctgaagtgctcttgtataaaatatcacgtgaagaaaagaagactttatcaatgtctaaaaaagtgggtttgttcatagacaatctgacaagttaccataaaaagtgtttcctgagacataaggaaatgcaacattattcttcttgaaccgttttagctcaactttccactcaataaaacagcagaggatctgaaactgagaaaatgtatttgagtacaaacagcttgtgaaagttaatactttttttttgcatcagagggtttttactgaacttacaaccaacttgcccactcagtatgcagttcagatgtgagagatgcttctctgtacaggagcctgtactgtcttcaatcctatgcgagcaagtgtctaccacaggcaaacagttttctccccattttgtagtaatgtaattttcctattagcaaaaggaggtcaccagcccctgtagacttaagggactcaagtcacaggatggggatatcctcttaatattttttattttgttgtttgaactcttgatgcaacattgtagagcagggtgttcaggacctgctgtgcccaagggactgataaaggaaaaagctctatttattctttgtgatttgatgcacagatgaaaaacttaacacacaataacagaagttggtcgttaataaatcacatcctagtctttcagcgcttccgtaagcagacgacatcttcagttttctagctcttgtagttttaacactgcagcatcaatgatgcataagtccagaatcagttacaaagaccatcatattctttttctcttagttcatcatttttcactatctcttggtcccaaatgtatctgaatgattaccttccggcattctctgctattgctcgttggagtgctctcgattgtccccgtgttttgtgggctggttgggagagggcgcctgggaaggatgtgccactgttgggaggttgtgagtcactgggatgcctccagggatgatcccttccacggctgcaggaagtcctcctggagccacgcccacgatgcctggcggatatctgtatgtggcaccattgagctcaggatgaattgcttgctggtctattactgaccaaggcgctgatgtgacagagaattccttgttcacacagtttcttaagctttctgggatgtgacctgtgatggctcggcggatctcagtggcagctgcctccctcatctccagtgacgcctgcttgctgtaccaggcagtgtgaggagtgcagataagattcggtgcatctttcaacggaccctgagcaaagctaaagggctccgactcacgcacatagagggctgcccctcgtatcctgccctccttgagagcttgtgctaaggctttctcgtccaccaggccaccacggggtgcgttcacaaggaatgctccctgcctcatctgctttatggtaaagtcattgatgaggtggtggttatgttcgttgagattgcagtgcaaggagacgcagtcgctctgatacagcaaatcctacagagtgtagaccctctgcacgcccagggatcgctcgatcccatcctgcaagtaggggtcataaaatatgacgctgaatccaaaggccttggctcgaactgcaaccgcctaccccctgcgatcaaagccgatgaggcccagcatttccccacggatgctggccgatcccgaggccaactcgcggttctgctccatgctctgaacccgtgtgccttaccgcagtgcttggtacagccatgtgttcctctggtacagattgaggatgtggcagatggtagagtccggtgtctcttccacggctgcagacgggatattgcacacagcaattccgagctcgctggcagccttgatgtccacgttatcgtagccactgcctatctgcacgatcactctcggggccttaaacttttctaggtcctccctggtgaggatgatggtgtggtacatcatggtacccatggcttcgttagaaccttctcgtggatttcctgcgtggactgcgcgtcacagaaggccacagtggccaggtctttcaggatgggcatctccacagtgcagtcgcggccgtccagcagcgccaccagggggcaggagtgcagggggccgttcatgatctgggggcggataccttcacaaattctgtccaattgctgtctcttgactttgtgcttatccacaagggccatactttatggaactttgcaactctcagatcaaaaggcaaagcagtcctctaagaacttaggggaactcgcaggagtctccgtgcatgacgccactatgaacccactataaatctgtacacactataaatctgtacactataaatctatagttcacacgatgggctgtccgtctttttaagggaatacagcttcattggttcaaaaccatttaaggtgatgaaaccctcgtcccggacggtcagcgtccacggcaaaaggcgcccactctggaggccgcggtggcggtggctcccgcccctcccaccccaccctgcggcggtggcggtggcggtggctgcagctgtgcagcctcccctcagcgcagcatggctcccttttcggtccctcgctcctccgggccgctcccgagccaccttaaaatgacgctcgcacacagggacacacaacacaaaaacttaatctctccagctccccaccactccccctccctccctccgctaccccgctctccccaccctacccctccagagaagtcttaatgaggaaaaaaaaaaaaaaagcacaaatcacatttccaaaatgactggagatcctgccaccactagggttatgaaaatgggcacaattttaggctctggctattcagccttgaagaagtctcagtatccaggcacctgagtttgctccatacccacctcctccagggctgcgacaaggattaaaagtcaagttagtgaaagcactgcatgctgcctcatatgcagtaggtgcttaataaatgtttactaaacctgaacacatacaaatcacaagggaaacagataggaataactgccctctgaaaagcagggcttttctacggtggcttaaagctgacatggcagcatggcagatccctggttctcagaagaaatctcggaaaaggaagagatgatccatggaagaaggaatttgaggccattctgatatagaggaaaccctcgatgaacatcagtacccactattctattattcctatttttatcctcagttaaacatagtgaattagccactgtgttttcctcctgaaattccacaaaataaagacaaagacagtaaaaagaaaagcaaaagatattaaatcacaaggggaaaaaactaactgtagacacatgagcagacaagagatttcatttttttttttttaagacagagttttgctcttgttacccaggctggagtgcaatggcatgatctcggctcactgcaacctctgcctcccgggttcaagcaattctcctgcctcagcctcctgagtagctgggattacaggcgtgcaccaccatgcctggctaattttgtatttttagcagagtcagggtttatccatggtggtcaggctggtcttgaactcctgacctcaggtgatccgcctgcctcagcttcccaaagtgttgggatcacaggcgtgaaccactgtgcctggcctcaaaatttttttaaaacataaaaaatacatgaagtagggtttcctggcagccacagcctacactcctatagaggggatattctagaaaagtgagccaacatatctgcaggaacctgaagccactcagaatttgaaagtaccaggggttgcagaaggcagaacaaagcatggcactgacaatggggtgactgggtcaaagtctgcacacaaaactgctggacctcagttctcccacatcttcccatctgtgcaagatccaaggagagactctggacttgaggacaccaggggaatatgtagacccagggctggaggtggagaagagcaagagtctgtagaagaaactgtgccactcccagcttggcagaaacaatgttcagagttggtatctccccttggtcagggaccaagctggctacaacttctccccacttagtagcctcagtggtcaacagaaagaatcagtcagagctcccatggagtcaaatcttaggcaataaagtacatcctacttataacgctgggagtaggaattgggactttaaactgtgttgaaaagggtgcttggagaaacacaagagtataaatatgaaaagctgtaaaaaatgtcatcagctcacacacaggttacaaattactcacaggttgttctccttggagccatagggttcagagcaacactagccttagacacaggcaagaggggcctttgaagtttgggccccacacttttaaagggtcccacacttttaaagggtcccactctgtcaactgttcccttctttataggacaagaagactcccaagtgaaggggatatatatacccagagcctacagaccccctcacttctagaccacgctccgagatgtcagactccagaacattctgcctagacagctctgaactcttatcttacttccaaggtctgtgtggcctctttccaggtctggcttcccaagaagaactagacaaccacctgtatactcttggatgttcggtgggggtgggagtgaaaaggctgctatttgttggaagatatgaacagagcttgagctcggaggttagggtgtccatgtagaagcacgcaaggcccctctctttatgggatggagccagcggtggggagaaaaggggtgtaggggcccacacttcctgaccagtcacattttggcacagaattccaagtcgtccatgagtcctcaattcgaacctggccatcctgttcattatgcaagtaactcatcatcagaggatgcaacgtacttggcttaacagtttgctggcctgatttatcacttctaaatatttagacacatgataggcatgccttcattcatactgtttccccaagccagacaaatgtttgtagtgggcctggttcagagcaggtgcctcacagagacaaggctagataggattgcttccttgcctggtcccagcttcaaaagttattctaatctgttgaggatcctcaaaggaaaaactattttaaaatatgcggtttaaaatgaaaattgtgcacagtattttaatgtacaattactccatgttaagctcctgtggtttctgtgctttaaattacctcatttaatgttcccaacaattccatgaagtggacagaatattttattttaattaatgagtaaagtgatgccctcagatcttaaggaacttgtataaagtcattgaaattgccttaaaataaaatcacttttttggtattgcttaaagaaaactggctaacttgtgatagaagaagcccctcaaagcagtcacacaatatgaatatgctaagtctttaataatagcaacagctctccttcatcagaggctaacatgcaccagccttcttcaggcctcacatccatcctgggaggaagacgttatataaattgcccaagaacatatggctagtaaacagcagagctcaagtctggatcacgtaagggccccactgcactctactacctttgctggtgaaaacaaacaaacacagtagaattcaaaagaagctaacagctgaatcaagcatacttggtcaaagagccactcaacacaaactaaatacctttccagctttctacaggagagaaacaggcaatgttcctgggaggctgcaagtatggctcataagaatgtctggaattatctaatctaagctttctaaagccatctattgttggctgttaaaattatagcatgttctgccgtctcttcacgttaccatctccttacttcccgtgcaatctgaagcagaggtgttattcctgtttatgaggtgaagacgccataactcagaaagccctaccctagaaataccagactcaggaccctagagcttcatagccaatagtctcatagcatcctgccatcttttatgatgtacataaaaaaatagaaatcacagggagaatggcctgttcaagtgacctttactagactgtgatatcactcctcacccccagacagatagcacacatgaggtagcacaggtcaatcttagcagacctggttccttacctgttaggataagacttaacgcctagaatttcatgattattacactagttactgcatgaaaaatgctcaagacagagcagaaagcatgaagggtaaggtattgttgttgacattttattagggaagtgaaactcttatccttaattcaaaataattaccaggtttcaggaacatggagcttcccactatgaatccctaatccaaacctagatcacaaaacccagaaacgggaaagcactggacagaggaatacagtaaaactgcgaagctggttacctgaattgttttctcttctgcctccagtggacttggaaataaagttcagcattaatgatgatgttgcatttaataaaacactggtttcatgactcctgggatactgtgtgggcaatacttcccctccaccctccagagataatgaaggcgaggaatccaatttgaactccctgggagaatggcaggaaggctaagctacatttggcactatattagaactttccctataaaacaaggacactggttatatcagtttcatgggggtacagttgtaaggtatcagcatagggcatttatagatttgaaatccatggttttccatacctatactataccagcagctttggtatagaagcccataggtcctatgggctagccaagcttcacatttctcaaatagctttggagacatattttagttgggtggagaattcattcagaggaggaagggaagtgtggaaaggcactgtcgttcgttacacttactatttccatcctgttatgggggcagtttcccctatgctccagggttccataggagcagacctagactgcaaagtgtggttacagacagaaagatccatgcctttccatgttgggaagcatcaactaattgtatccttaggaagtctgtctctataccagttatactgccctgccctgcttgagaaaagcaaagccaatcagtttttctgcaggcaagtggaaagtcagagaggagggcaagtaccttctataagccagaaatggtgggaggggggtgctagaaatcgctaggaaagaggtctagtgtccccaagaaatctagggcagctgcttaatgtaagaatggtccctggggtgggaatgtggggagaaggaaaagcaatgaaaaggccactagagccttaattgaggaagacatcagaatgcttgtcacctaagctctacaccttctatatttgaaacaggtatttcccagccaggatagtacaaagtgtataaattgggcaccaaatggatgtgattttgaattctccttttatgacttcccacctgaacaaccttgaataagtctcagtttccacctttgcagtatggaaacagtgggaactactccctaagtctgttaaccaataccagttccttctccatctagtcccagggtggctgggttatattgttgacctattaactggaataaaaggggaaaaaggagaggacaagatatattagaggaaatcaggaatgattttatggttgtcaaaagcttttaggttcctagagacactttgactttcctgggcctttgccctgggaaaaaaattaaagaggtttcaatgctcgtgtgcattcccacattacataggggagctgccagtcaccagagtttgtttgggtaacctcagaaagaggccacagagacaaatctcctcccagcctctggcagacatataatctggagttatttatgccagcattccttccccaataaaaaactctctgacctggcttgaatttttcttgacgctttcaattaaggaaataacaaaaccaaccctgtcttatacatggttaggtctggcaaaaatggactcagctaattacaaatttggccctggcggttttcttaagatgccctacaggcctgggtgtgagtggttataaaaatgaatgagtacaattattttgcaaaccagcctaacagtttagttcacattgcttctcgtctttcctcatcaaatcaagcatttgaattgcagagaattatcttccacatgtaagaaaacatatttctaagcattgcaaaactggttccttgctgtattctgatgcattatcatctggttgaagtcacatatctgtctatggaacatgacaaggacaagggagaacggtgctcacattaggttctcttcaaagtgacatgcagttagaaaacatccacttacccctattgtagccaaggctactagtacttaaatgctataccactgaaaaagtaagtggagacatcaatttttttaaataaatgaatctgaagtaccaccgaatatagaaaaaaaccatatctattgttcaccaggttggagagtagctctttcctcatctaactcaacacgttcaccctgaaggatttcatctgctcctgggatgcaagtcaccctctccagtccagatttccctcttgatatttgaatttgcatgctcacttttcaccagtctctcctctttcatggtttagaaatgcaaaccaccaaatttggtcaactctactaggtgtctttcagatttagcctcctctcctcactgatatgccgcttgttcaggccaccattatctccagcctccatgactaaaacacctgccctgttcctgtctaattttcacacttcctgctacagaaatgatttctaaaacactttcaatgcctttatattgtcttcagtgtgatattaagactccttaaatggcataattggctaaggtgttatgtagcagcctaggttctagttctatgaacgttcactaccccttctacctaggttggccacttcaaatacagcccctctcctctccagccttggaagatgagtaagagctcagctttggagacagacaggctgggaccacagcccaccttagctacttggtgcctatgcaatgttgggagtcactaaatgtctctatctgtaagatgaggataatggtaatggtaatgcccttctcctatcactgtgaggagtaaatgagataatgggtgccaagcactcagcacaggcctggcatatagtaagcactcagtcaatgctggctactatttcttttttttttttttttttttttgagatggagtttcgctcttcttgcccaggctggagtgcaatggcacgatctccgctcactgcaaccttcgcctcctgggttcaagcgattctcctgcctcagcctcctgagtaactgggattacatgcatgggccaccatgcctggctaatttttttgtatttttagtagagacggggtttctccatgttggtcaggctggtcttgaactcccaacctcaggtgatccacccgcctcggactcccaaagtgttgggattacaggtgtgagccaccgcgctcggccgctggctgctatttcaaggctagtactcaaggttatctacacctgctgtactcagggtccccataatcacaccaaattttatgaagagatgcctcctttgagagggtaaattacaaaaggcttctttatctgggctgcagacagtgcttggcatccccgctcgtgccagactcctactcatcttctggaattccccccagatttactcttgccttcttttactcacccaaactcaatatggcaccccccccttgctcccacagtaccttgttcacccagcaatatgacacttatgacacttattctccatgttgcttctcctgactacttatccccatctctctccctacccatctcctatttaggctgggttcctaaaagccagggactgactcagtcttgttcacagttatatcactcatgtctttgcacaatagatattcattgaatatttaccaaattaatgattatcatccttctttctccaaataactcttacaaacctaaatttcctgtcactctaccatcaaacaagtggtttgctctatattttggtgacattcatactttctttctccatcacctgcctttttacttctactccccccaaacccctgcacacacacccctgaaatccctgtgctagatggaccatccaactctatttttgtttccaccaaatatttttgagcacctactggtgtcctcgcacaagattggatgtaaagcctaaaaccataaaaaccctagaagacaacctaggcaataccattcaggacataggcatgggcaaagacttcatgactaaaacaccaaaagcaatggcaacaaaagccaaaattgacaaatgggatctaattaaactaaacagcttctgcacagcaaaagaaactatcatcagagtaaataggcaactacagaatgggagaaaatttttgcagtctatccatctggcaaagggctaatatccagaatctacaaggaatttaaatttacaagaaaaaaaaacaaaaaaccccatcaaaaagtgggtgaaggatatgaacagccacttcgcaaaagaagattctaatgcagccaacaaacgtgaaaaaaagctcatcatcactggtcatcagagaaatgcaaatcaaaaccacaatgagataccatctcatgccagttagaatggcgatcattgaaaagtcaggagacaacagatgctggagaggatgtggagaaataggaacacttttacactgttggtaagagtgtaaattagttcaaccattgtggaagacagtgtggcgattcctcaaggatctagaaccagaaataccatttgaactagtaatcccattactgggtatatacccaaaggattataaatcattctactataaagacacatgcacacgtatgtttattgtggcactattcacaatagcaaagacttggaaccaactcaaatgcccagcaatgatagactggataaagaaaatgtgccacatatacaccatggaatactatgcagccataacaaaggatgagttcatgtcctttgtagggacatggatgaagctggaaaccatcattctcagcaaactaacacaggaacagaaaaccaaacaccacatgttctcactcataagtgggagttgaacaatgagaacacatggacacagggaggggaacatcacacctgggcctgttgaggggtggggggatgggggagggatagtattaggagaaatacctaatgtagatgacgggttgatgggtacagcaaaccaccatggcacatgtatacctatgtaacaaacctgcacattctgcacatgtatcccagaacttaaagtataattaaaaaaaaaaaatactcagagaagttccaaatgctgtatataaataaatacaaatcttatatagaaataggatttggaactatatacatgtatataaacataaaaatgtatgtttatatatgtctataaagagtgaaacaattaaacttcttctataaaaaaaagagtagggataaaaaggcatataaggcaaagtcattgccctcaaattgtttacagtaaagtggtgaaggcaggtatataaataagtataattccatgtagtttgtactgcattagaagtatatatgaagtatacagtcagcacaaaaagatcaagagttctgagtagaaggtcaagaattgtagcacagaagacacaatcttctggctcaccctactgagaagaggtgatatttaccaatgaattgcagaataggagttcactaggcagcgagataggaaaaggcattacaggcagaggaagccccatgtataaaaagtcacataagcacaaaatagcagggaaagcaactaattcaatatggcagggaatgtgagagggactggagggaacagggaaggctagagaacaggaagggtctaatgacaaagggaagaagcttgccctgagtgctgcagcattttgcttagaggatgttaaagcaaaggaggagattctggcagctgtgcggaagacggactgggatggggggccaggtagacaaagagacatcctaaggaaactgaggcccactgctaacacagttctcagtgtgcttaagacgatttaaccttgtggaaaatactgccaggaggatattttctaaggaatttgtttaccaaagaatctgaacccaatgatgaaccaatctttcgctaacaaagctagagaactcagaaccatctaagttagcaagtgttaaaacactggaaagcaaatgtggcaacagcactttcctatttgaccataatcaacatcaatgtggaaagaaaacaaacctgaaagcaagtgaggaaaacacacagtgggtttctttgctttctctccaggacactgtcagtacacagagcatttagaatagctgatttgatcgttgtgaaaatctacctgcgtgcccctctctctctctctctctctctgaatgcaattagagaagacagcttcattcacactgtgtctaaaaatagatgatggcagagttcacagactgacagctgcattgtcatacagtaaccaggaaaggaaagggatggctaatttaacttaacaacttccaaaacaaacagtgcagagggagtccaggataaagaaaaaacacacaggtcagttcttcaaagagctggcagagggatggggtcgctccatggcagtttattagtcctcccaaaatcctgacgaaaccagctaagtattttgcccagatctacccagagtccttcagacaagagctctggcagatgaaccgctacagagattcaggcaatattaggcagcagggccaggactttccctgctgacttcttcatacatcccctggacacaagtaagctaagaagagtcatgacgtttttctaggcaagataaataaatgagttttttccccctttgccatatctaaattatactctgcctagcctggggcatttaaaaaaaagttatccaggaaataaacatgcatcattaaggggcagaaaccaggtgtctaaaagaagcaaaccatttctttccctcccttcagtcctaaaatgttttctgttttcctcctcagtctgccttgcccagggaagggattacggttgggcttcaaaagaaacaagggaataatgcctgtggacgggtagcagattctctctgcagctctcccgcagctccatgttggctctcagcgctgctgccagccagctaaatgtcagatcacggcaccccaacattccctcactgcatacctccatcgccctggtgactaagctgtttcaacagctgtgttattgctggagtcaggccagtgttattcacacgaagtatttgtttcatacggcttatgtggggaattattgcactcagctttggggttctatttaaagataaggtccttcccttgatcaatcagccaggacattcctcgagttgggctccaggagacagtgggacaatattctactgccacccggggttccagataatggacagattcataatactataaagaaggtggatgaagcatatgtgtgtgtgagagaatgggaagcataatggaaaaccatgacccttggtggagctgcggaagaactctgctgctcctccctcaataaaagccacccacaacacaagagtgttaagctggactccctttctgctcttcttctccagccatcaccctcagcctttcccttaaaatcattgctctttcctttcgggtcacgctagcactgttgcgttggtctctacatgcatcactccacacacctgccccgaatgccatctcctccctcagcccttggcttctcctatctcatcaaatggtttatgaccattgatgttcctatcatgtaggaagcaagttgggcctgttggcctggtgacctcctccactactccacatcctcttctgagtgtgagtaagataagggctgtgttactaactgctgagttaatcaacccaaactcccttatatggagggacaactgggaaaaggaaaaggcattacatccatgagctttatgtcctgtaggtgggactaatttctatttctagctcattctaggctgaatctccatcaaagaggcctactggcctgttctccctccaaagttgttctcaccaagagcaatcgggcaccattttctgatgctgaaaagatctcagaaatatgttttcttataaatgaagtatttttaaaagaaataaaacaatgattcctaagagctcacattttttactgcctactatgtgtagacattttcacccatgcagatgccagccagatggaaaccatcacaggcaatttcaaagtgaggaaactgaggcccatggccatgctaccaatgtgagagggaggcaaaatgagaacccaggtttgcctgactcagcagctcaagtactttccccttatgtctctcagtcatggggtaggaaagttaggacacccgcttcttgctctaaaaaggccactatttagccaaacaatttgagtaagtcactttacataatgtattatttcatgaaatactacagttggatcataggcttactaagatcctttctagttctaatatttcatgaatgtagaaatctaaaacacctccagctgttgactgccttctatacttaaggcactgaggccaaaacaaagagctataaaaccatgcctgtcctcagggcacttataatggagtttgagtgacaaaggataacaagttgagtttgactaatggaagagttaaacaattaacaaatacaaaaataccagagaaccagactacagggcagtgcttgagaaataacaccgcataccagcatgactatacaaggagaaaagtagatttcaacaatggtaacacccctaacccggaaaatacatttgtgctgccagcagaaagaaaagaagagacagaaaacgcttgcaggaaaagccagctactagaagggatcccgtctgtttcacaggaaagctttgtttctgacaagtttcgtaaaggaaaaagtaggctagaacaagcttttttatttccaacccaccttttcttcgttcccatgaatgaggaggggatacaaatgagagcaggcagccagggacaaaaataatatggctggtggttcctgacctcttggattcctgccaacagagaagcctgagaggcaacatttaattgtggaaaaaccagcctggctctcctcttatctttttcctctgtgacttaaacccacaattactggcaacccctagattccgagtcacccagctggtggtggcagcaatggctgtgtctgtagctgaaaagcaaaagggagtcagattttacctgcctccgaagccagccctgggagcacagccctaacccagcttgatgacttctcccattaaaaggttcacagatgccctcccgttgggaaaaccaccaagtgagaagtccagatgggaaaaaaagaaacacgattttcagctgctgtataattcaaaggacaagctacgagtctcaaatcctgaattccacattttatttcagcactagagatgtgatgttcaattccttttcttaagaaacaaactccaaatttcttagctggtcatcaaggcaactcacctaccaggccctctgtctttcagcagctcatcttttttctctaatatggacacttttctacagcccaacaaatgggcttaccgtcctttgcacatatgttatttcagagcatttcatgatagaaaaatatggtcttagtcctcactttctcacctagaaatcactttgaagaagtcacttaacttccataatttcatacttgtttaaatttaaaactttttctccagtaacagcctcacagaggacagtagagatttaaccttgaacatctagcattgagcctgcagaggagatgcataatcaacgtttccttctctatacctaatgcctttgctgagttaccttcatccaaaagaatgttcccattgctaactcttgtcctgatcttttcttaccactcttccactccaagaggttgtctcccatacacctctgctcccatcttaatattcttccatttcaaaatattttaatttacatgctgctatgtttatagtcaaatataattaaatcatgcctgtgggcacattctcctaaggatgctaagaattttccacatcttctattttaggactttatccaattgcttcagtgctgatcagcatgcattttggtactcatggggcataccctcatcgggattcataaacctctgaattccatgggtgagcttcagggcttccattgaaatatgaatactaaatgtgcaaatggggtctatgcatatttgtctcccaaggttaaagtccttgacctgaagttaataaccactgtccggaagtaatgaaaggcctgtggctaacatccatggacggggtcctttttctgaacactcagccctgccacctatgtttctgggcttctatgctctctctggaacacaattcctcctttctattcaagtccgagaataataactactcactcttatttatttatttagagacagaatctcaaccaggcaggagggcagtggcgcaaccttctgggcccaagcagtcctcctacctcagcctcccaagcagctgggactacaggggcacaccaccacatcctgataatttttgtattttttgtagagacagggtttcaccatgttgctcaggctggtctcgaactcctgggatcaagagatctgccctcctgggcctcccaaagtgctgggattacaggtgtgagccactgcgcccagccaactattcacttatattgagcatttactatatgtatccagcacttactatgtaaaagcctcacatacactattctagtttaatccttacaacaaccctataaaggtagtactactattctattttataagtgaggaaaatgaagtacaaggaagtttcaaaaacttccttgccaagggtctcataatttataagcagcaggccaaacattcataatttatgattcagcccaaacactctggcttgaaagtacttaacccagtgctggagttgtctctccaagctctttcactttccagaaaaaaataagactgcccttggactgtttctttgccttcacattgtaagtgatcacagattccaacgcctttaaaactccacctttgactcaatcaaaacatttccttttccgtgagttaatcatttccccttctatgtttatggactcctttgggtacttaatgcactgaacacactggtgtaattttttaattctctctccatgaattagactgtgagctcctaattattttgagtacacatggaatatttactgtgcctggaattgtgctaaggatataacaatgaacaacacagtgtccctgcctttaaataattcactcttaggccaggagtggtggcttacgcctgtaatcccagcactttgggactttgggaagccgaggtgggcagatcacaaggtcaggagtttgagaccagcctgactaacattgtgaaaccccgtctatactaaaaatacaaaattagctgggcatggtggcacacgcctgtaatcccagctactcaggaggctgagacgggagaatcacttgaacccaggagggggaggttgcggtgagccaagatcacgccactgcactccagcctaagcaacagatcgagactacatttcaaaaaaaaaaaaaagaaaagaaaagagaaaactaaacaaaagagggttatgatggtttctgaaattgtattatgaagaataaggacttatctttatttcttaaatcctgagcaaaatgctagcatgtagtacaagtcccaataatgcctatcgaatgaatgaatgaaattgggaaagggttttcagatactgaactgctaaactgaaagatctaccatcccatcatgaaactctttgaggttatttatacactgactcacctaaaaactgcttcctgtgttggtgtctatgatacattttttaatgtcagactaaaaatacacttccagtacaccaaccctgtctgcctacctaaggagtagaaatgaacacaaggtcgcatgtaacaaaagaaaagaaaattcactcatttcaacactaagctcaccctctaacaagagcatctgtcttgactgagcactatcttctagaatggttttcacttgagggtctctgaagtcatctatttacaaaaccaaaggataccaatgagattttttataaagtcagagaatcttaagtgagtcatggactctcaacttcagagagttagagtagatgggaccttaggggtcgtctagtataatttcccactcagaacaggaagcactccatagccctgtcaatagactcatggtgggatcaaggcactggagtcctaacatcatgtacactcatagcctctcgacttcccagctgggagactggcaaatcatgtaaactctgtcatcctcagtgtcctcactctgccagatataattgttccgatgatcagatgaaataaacgttgtcttaattagcgaacatttgtttgcaagtaacaggacttcacccccactaacttaaccagaaatcagctggagggatacaggagtgctttaggaaaatcaagggcagaaaatgctgagaagctggagggtctgaaaccaggaatagaaagctgtcaggaggaaagtcaactcttatagtctattgtaattacactaatagtcttcatctccatttcctctttgcatctggtcttcccactctgccagtcaacaatcacggcttctctgtgcacgtgtagaatgatgactgcccaggtggctctcatggcttttcagtttaagtgctaataaaggtagatctcgaattactgaaacacaatttcttataagagagaatttgattgcttcccctttggccaagggaccactgctagtctgatcagttatggcttggggactgatcatatggccagttgcccattcagtagaggtggtggaacatgctgagggagggggaagttaaggccaagttcaggccaagcaaatgactgacaacaaagacaagcaacagcatctctagtgcgatggtactttgcaaagaaagcactgccccatgccagctatcactgtggccatccttatgatcctcaccaaccatcttctgcttgaccactaccagtaacaggctgctcactactggtagaggcaaccttttcatcagcaaacaacttcagctattagaactcttttccatgtgacagcaacttaagatactaaactgaaatatttgtaatcttctcccaagccttaactttaatgaaggcataatcttgcttgttaggtcaagcctgggcttttctttctagtcaaaatatgaataatgggcaaagcaagatgttgaggaaaagctgagtgttgggagggaaactgaggcagggcttgcataatgtctttgggaatgtgtctagacttgctggttccttacttctagccctcataggctcctaggctcctattcccattatctcaagtagcagaacatgttccatataaatgctaaaccatcacagctgtagatcatgtgcctgctcttttgacctccacattttcaccacctgtttctttgttggattaccaataaatagcatgggctcccagagctcagggccttcacagcctctgtacactagtgatggccccctggtgtcccaactttctctctcaaactgtctttttctcaatcctttgactctgctggactttgtcacccccacaacctggtgttgggtctgatcaccccaacacaagagagatagattcactatgcaattattttagcaaacaacctggaccagaacaaagccagaacctcttcttcctataaagaattactactatctctctactaacaccattactaatgactcactaaagcaaaagaggatctggaactgtttctagcatcagtgtgtagacaataggtagggttggggaaaatggttttttccaatgtagagtccctagcacttttgcaagcagaattctgccttgctctcatttaacttccttttgcttagaaaaatataatccagaaaataatcttaacttcatttttttaagttaaccaagataaagttgtgaattccccataaaagaacctcataatagctatgttatgaccagctggcatttaaatactgaaagacccaaagttagaagaggaggtgaaaacaaaaaaataccttctatacattgggggcaccattaagggatgtgctgcttctggcttctctgctcttcacattagtcaatgatgtcaccaggtttttattttagtaatcaggatatacttgtatggatgcaaagagaatatcctcatttatattctaaactcagagcaggaaatgagacacgtgggtgatctgcagctgtggcactataaacagggccagcctaccacctagtctagattctagactgcacttcattccctgaaatactgattgggagattttaaaaaattgaaaatatatcattttagaaagaccagtgcatcttctgtgcaaggatcttagagtccgctgtttggtagaaggctgactcacctgtatggggtggtgcacgtgttgttaggtaccatctacctatctacaccactgatgtacaacgaggagatcctgccctggctccagccagctgtgccaccgtgggcgagtaccacagagttcaagctttctccagctgctaaattaaaggattagtgctttaacttgggtcaaccacccatttgcaaacctgacaagaaccacaaacactcttacttcaaaaatgcatataagcaaataccactgaaattttatgtagagtatcaaggggttctcttagcccttacactccagtctaaactgcttggttgatgattgttagaccagcagccctctagtattcctttcagcactccaagctaaaataaaacagctgatgtttagtaacaatttctgcaaattattcaacaccatagaagagtgttttgttaagactagagactaatctaacacaatctactcaacaatgttaaattgaccagtaaccaatagatgactagaagaaagtgtatgtaactagatataccaaactatagatactaattttaaaatcttggaaaggttttggaggagccctactgtttctgaattggaatttttcatttgcaaatacttaacaaaacccaccaagccagatagagctctatagcgatgcctatggaggagccttataatgatgttgtccaagtaatgtgcttaacaataatcacactcaaagccaaaggttcccatgctcctgccaatataacatgctcacaacggtcaattccaaaggaagagctgtcaagaagtgcctgaagatttcctcaaagggagagataattcatgagcaaacaaacatcatgtccctaatcttctctatcctggggtaaacaaaatatagttttctcccatgatttcagttgctttctataccaagtcagtaagtaaaactgattcatactggtaacttccaggttccagccttggtttgaaggggcacacaattcaataagagtaaagaagactggccatgtaagcccatcttgaatactgacaacttccgtaccatttacctaacactacaaaccctactccatttaagtctctgagatctttttgatgtattttgagcttttcaacttgccttttttggtgggagaggagggaggaggagaacaaagggagaatttgaagtttttatttctgcttgcattgactcaaattgtggtaaagaaacttaaaaggtaactttaaaattctagtgacactagccaacaatgaaaactatctaattagaatgttagaggttttttttgtttgagacagagttgctctgttgcccaggctggagtgcagtggtgcgatctcggcttgctgcaacctccacctcccaggttcaagtgattctcctgcctcagcctcccaagtagctgggattacaggcacacgccaccatgctgggctaatttttgtatagacagggtttcaccatattggtcaggctggtcttgaactcctgacctcaggtgatccacccacctcagcctcccaatgtgctgggattacaggtgtgaaccactgtgcccagccaaaatgttagatagttttaacacaggctataacatagtcataaattaaagaagacatggtcgtaaatgaaagaagacctctttttggtgggagtagtagtaggggtgggagagtagagttatacatttcttcttagcagttgcttcaacatattttattaataaggactatctgctgaagcacagaaatacaattatgtgaatatcatactaccaatggcctgttccatcatagcagggatagttcttatagtgtataaaatcctctgccccattcagctctctttatggagctttcctcagaagcatcagaaaacacagaattaaatatcacaattcttgttgaaggccaaaaattagttcccagaaggattctttgactttcatccttctacaaattcacccatcaccattgtagataatgtgaggggtgaatttgtagaaggatgaaattcagagaattgtttatgatcaatagattgttccctttattccagttgtcttcccttgatgtccacttaacattccataataaatggacaaatggaaaagcacaattactctgccaaaagtcagtcaacattctcccaggacactcagccatctaacttgaaaactgactggtaataatatcattctaattactttaactagaaatttgttatacagaaatgctttcagtgtggggaaagaaaaatcacttgccacttatagaaagaattctgcttcatgtgaccatttgcaataatgaaacaagtaagacaacactgggttccagtgtacagcacaaggatcaaggcgaaacataatgctttcattacgtaagaataggactgacattattctggctttcccctacccttcatcatttaccaatattttttcagtctcaggaatttttcaacccctgaaactcctagatttactactcaagacacagctatccatcttgaggctttctgccaatggctctagtgcttctatttcaacagcttatagatttgaaagctggaaagagagatatgtaaacaaattctctaactttgatctatgcacccaggtttctcaaaagaagcccttggagagtctggggtatactaagtgtatgacttgcagttgtaatcattagagtgacaacccatttccagtgggtaccgttttagccaacccaaacctttcttttcctaatgcatagagtgactttttaaaaaatggtatatttgggaaagtattttagaatggcatgttaacaaaacaaaaacactctagaatatattttcaaataacagaacttggccttaccaagaggtctaataccatcaggtaaataatcatttttatcagtgattcataatacatccagactctaaatgttaaggctgacttttttctgacactcttctctgcctattcatactccatttcctaactcctttagagtaaaaattgaaatcccatatccctaacaactagacagaagcatcatgtttacatcctgacaaattcattaattctgtacctctgaaatatttagcaaaaagccagcactgactcaatcatagatttccacagacaggtctgttcatatttgtaattggtattcactgaaaggtcaatgactcctgttcccaagtatctatgagtctctagattttcttaattggcctcttttcctcagctcttacagactattgttttaaaactaccaccatttagaagttgaactccgagtgaggggaaaaacaaacaaacaagcaaacaaaaaaaacactttttgattcccactccactcataatcaacataacacagactacttctgacccaggtgtgatggaaggagcggggcacagagtcgggggaggtttctccacacaccaagcaagcaatcaatcacttccacagcagacatcagctgggtgtccaaaaattcaattttgacaccacttacctggaaatagcatcaagtctcataggttgaaagctcagtcccataagactgctccccacttcagatgcccatcgaaaaaacaggttgtggcctgttataaatacgcgttcccatgaccctcctccttaggattgattgatttgctacagaggctcacagaactcagggaaacacttaacttatgcacgttataaaggatatgacaaaggatacacatgaacaaccagataaaagattgatagggtaaggcatgtggtatggcagggatccctgaccctctggcagcagacaggtaccagtcagtggcctgttaggaactgagccatatagtagggggtaagaggtgggtgagcaagtattatagcctgagttctgcctcctgtcagatcagctggcattatattctcataggagtgggaaccctattgtgaagtattcatgcaagggatctaggctgcatgctccttatgagaatctaatgcctgatgatctgaagcggaaccatttcatacccaaaccatcccccatcccctcatctgtggaaaaagtgtcttccatgaaaccggtccctggtgcccaaaaagttgaggatggctatgataaggcacagagcatccctgtcctctctagggtgccatgctccgggaacctctgcaagttcagctgtctggaagctcccagaacccagtccttttgagtttttatggaggcttcattacctaggcatgactgattacattattggccataagcgagtgactcaatctttaggcctcttccctcctggctgttggtgggtggggctgaaattagttccccacccttctaatcatgccttggtctttcaggtgaccattctgaagctatctgggagtccccagccatcagttgactcattagcatgcaaagaggcattcctatcactcaggagattccaagaattttagaagctgtgtatcaggaaatttattactataaagtaccttataatgccatcatttttctcccaaaggcactggcttgattaaattcagaaattaaaacaatggccagcttctatagtgtaagtcaatgcttttctagttttctgagggtttggaaactcaaatcctagctaaaacctgtatcacttttaaattgaaaaatttaaagggaataaacatttaaccccaagtgactagaagtcatttaaaatatgtagtacttagattattttatctactcaaagactcttcaaaagtagatgaaaacactaaccagatatatattataaacccaagctttaatttcagagcccaaacatgaaatctcttctcattgtttgaaatctgaaactcatttcaaagactgccacgaaaagttaaaaaaaaaaaaatggattggtcttgacttttccttacatatgaagtaatattgttacaggtgaatctctgataagcaggaagccatcatgtgtaataggatcttgtttgccacactcccaaactcttctctgaagtcctgttcattgctgtcagaaaggaatccaaagtaatgataaacaatataaaaagtagagagtctcatgcattcttaataccaaaatcagagagaaatctagacctgatgtgcctgttatactaaaacatgtgtgtatatgtatattgctgaatatatataacataatatatataatctgtataatcaatgccttgctcagtgtccataagcaaaggtagagaggataaatttaaggaaatgaatattcccacaaacacaacatgtaacttctcatataatagttagcagctggccaggcatggtagctcacgcctgtaatccccgcattttgggaggccgaggcgggcggatcacaaggtcaggagatcgagaccatcctggctaacacggtgaaacctcatctctactaaaaatacaaaaaaattagccgggcgtggtggcaggcgcctgtagtcccagctgctaggggaggctgaggcaggagaatggcatgaacccgggatcgtgccactgcactccagcctgggggacagagcaagactccatctccaaaaaaaaaaaaaaaaaaaaaattagcagccaaaatgtgttgctgctactcatgaaaagtattttttggtgtggttttcttgatagctctattaagaaagttattttatacatttatcaaatgaataattagtggtccatcttgttaactttttagtatgccccctattaagtgctagttctcatgttataagaaaattaaggattatttttaagtcagaaagcttgagtacagtatttttgtagatgaagataaaatattttaaagcatgaagatgtacatgagaaaaaaataagacattaatatttatatatagaaatgttttaaagctttgccaacatgggcatttttgttgtttaggattagtatttgctgggaagtaattcatctgtgaaattatttaacatgtagaattatttcttagtttctggtttgggagaaatgctcaagagttgagcttaaaatcattttattcacactgctaaagctgaaaaatgtaaacagggagctttcaatacatttcaaatgagtttggagaattctaaaatattcaatccatttataatgaatacaaaacatcattagaaactggcaaaaaaaaaagtagctaaaagtattcgagttatttcacattactgggaaagtttcttttaaaaagttcagttataaataacattcactaaacatatttatccttttttcaattttggtggtataattttagaaatttatcgttgacttttaaaatttcacctaaacttacctgaggctctgcattatgttactcaatgattctgatgccaagttttgaaatcaaattataggccagtcaccttcagtgatgtaaaaggtagaaccacaagataatccagcactttcctcacaacctgaaaacggaacctgtggcaagtacctgcccaagtgtcagactatgctctaaacaactgcctgtcatgtaacaggctgctcgaaagcagcaacatactactcctatagtcaattcttaacttcttaaccacaatttcatcagtgtaaaaaatataggagcagtggggaccagacttacatatactgaaatgttaaacaacagaactcttattttgaagtgtgggaggggaggaagcacctcaatcagttgctttatgttccttttagtggcagaagaatgatacaatccagtattttcatccacagctccctaaacacaaagctgtggatttcataaatgtaaatatactgcgtaatctgcccactgggagttcatagtttagtaaggactcagagaagacaatttcactgtgcagaacacaaggctgataaagtaaacatcacaaggccagtaatgaagaatgcgtaaggaaagacagattatatccaggaaggaatgaggacgggagataatatagaaaatacctaggaaggctccaggggaatgtaaaatttgggatgttgtgaagaatgagtaggtttatctgggaggagcccttcatttgtgagaagaggaatcacaagagaggaagaggcaggcaggatcaatatcagcgaagacgcaaagggagaaactctctggatgtgtttacagggcaggaaactactccttttgaggatgcagagaatggttactggccagcagtgaggaaggaggctagaaagaagccttgagccaggaagcgagaggactctgaacaccgagtcttatttgttagtcactgaagatgttttgagcaaggaaatgataaattaaagctaaaagagtctcctccttatcagaggtttcaccttcagtggtttcagttagcagaggtcaatcacagtgtaaaaatattagatgaaaaattccagaaataattcttaagttataaattgtgcactgttctgagtagcatcatgaaatcttgtgctgtcccctgataagaatcacccctctgtccagcatctccctgctcctgcctgttagtcacttagcagccatctaggttactagatcaactgctatgtattacagtacttgtgtgcaagtcatccttattttctctcattgccccaaggtgcaagagtagggatgctggcatttcagatgtgctaaagagataagtcaagtgcttcctttaagaagatgaaagttctcaacttaaaagaaaaaaaaatcttatgctgaggttgctaagatctacaataagaatgaatcttctgtccttaaaattgtgaacagtatattttttctttcattattaattattgttgttatcttttactgcacctaatttataatttaaactttattctaagtatgtatatatgtataggaagacacatcatgtatgtatatagggttcagtaccgtgattttaggcactgggtggtcttagaacatatcccctgtggataaggaagacttacctctaccacgtgcttcttttataaagactaatctcactaaccaaggtgtagaagtaagaattggaaaaatggctgaatttcagcaataaggataaatataattggataattgtaatagctacttttaatttttaactgttttaatagtacttactatgtccaggctgggtgcagtggctcacacctgtaatcccagcactttgggaggccgaggtgggtggatcacctaaggtcaggagttcgagaccagtctggccaacatggcgaaaccccgtctctactaaaaatacaaaaatttagtcccagctactcaggaggctgaggcaggagaatctcttgaacccaggaggcagagattgccgtgaaccaagatcatgccaccgtactccagcctgggtgacagagcgagactccgtctcaaaaaaaataaataaaaaataagtacttactatgtcctaaaagttttacataaactaatttattccttagagtgagttggttaattaggcattattatccatattttacaagggaggaaactggctaagagcggttctgtaacttccccaatactgcagagcttttaaaaagtggcacaaggatttaaacccattgctgtaggactcctaagtccatgctcttaaaaaactttctatcttaccccctaatctagatataaatcagggatcacatttcaaatgaaactgtgactccattgaaaagtatgccagcaggtagtcagcctctaagatggtccttaatgatccccatctcctggcattcatgctcttctgtaatcacctcccttgagtgtgggttgaacttactagttcacttctaaccaacagaatacagcagaagtgatggaatgtcgtttgcaagattcagcggtttccctctccagcactgctcaggctctctcttggctcactatccctgggggaagcccgctgccatgttgcgaggcagtcttatggagagacccatgtgggagggatggaagcctgccaacaaccatgtgagagagcttggaagcagatcccccttccccggtggagccctcatgcctgatgagactgcagaccaggccaacagcttaattgcaaccttgagagagtttgagccagagactcccaaactagattcttgacccacagaaatgaggagctaagaaatgtttataggtggccaggcacggtggctcacgcctgtaatcccagcactttgggaggccgaagtgagtggatcacctgaggtcgggagttctagaccatcctggccaacatggagaaaccccgtctctactaaaaatacaaaaattagccaggcgtggtggcacatgcctataatcccagctactcgggaggctgaggcaggagaatctcttgatcacgggaggtggaggttgtggtgagccaagatcgtaccattgcactccagcctgggcaacaagggtgaaactcagactcaaaaaaaaaaaaaaaaaatgtttatagttgaaagctcctaacttttagggtaatttgttacccagcattattaatacagtcagtagacagtaattatttattattacagggtaaatctttttctttatacttggagctagaagtagggatctgtctaggagagattatacctgaaataaccacaaccagcccaaataacagaataccacgtcctttacctttccacccaaacatacataaatcaggtaatctacctatctcatcctcccatggctcttcttgttgtccttattctcctttgcttgaatgcattcttaggaatagaaatgctaaaacccaaacctgcaggtttcaaaaaaaaatttttagacatacagttttgaatctcatagcaaactctttccttcccaaggctcctcacattacattgtgtattcttattatagcacataacatgttttttcttatttgtaggtttaagtgtctgttttccaggcaccctcttccctaacccgttacaagaatcatgtctcgtgtgatcttatatccccagtactgagtgttcgtatggctgggacttaataaagtttaaatgaactcatgaataaatgtgttgcacaaccaatgagtgagtgagtgaacaagtgagtcaataagcaagagtttagggacatgggaaccaccacttaaaagcttgaggctgttgtgcaaatttggaccttcatataagccatttccttctatatagaatgctctttcttttgctcatcctcacctcctcaccaggcttttctctctttaacattcacctcaaagagctgtctgattgcctctctacaactctccccgccaacacacacccacacaccctaccagggaagtcttccttttctctgctgtgaagccttttctttaagtttccatatcctcctgggcataacttggtcacagcacccagcataccacactgtaatgattagttatttgcctgtcatttccacttagccgtaagttccttaaaggacagcatattcagctaacagcagaatgcctagcagtggtaggcactcaaaaacagtttaaaataatgggcaagagaatgaatgaatgagaaaaagaaaactgtatctagaaaattatctcagcacaatctatttatttcaggtaagctatcagtcaggtatacatagtgctccaactcctaaacagagtaaaaataattgtacatcaagattattacagatacatgaaaatcatatttagaaatagtacttcagatcaggcatggtggctcacagctgtaaaccaaaaatttggggaggctaaagtgggaagattgcttgagctcaggagagacccccataaaattttaaaatttaaggccaggtgcagtggctcatgccagctactcaagaggctgaggtgggaagatcgcttgagcctgggaggttgaggctgcagtgagctgtgatgacaccactgcactccagcccaggcaaaagagaaagaacctgtcacacacacaaaaaaaaaagaataaaaaattacaaaattagcgtgcctgtagtcctagctattcatgaggctgaggtgggaggatagcttgaacccaggagttcgaggatgcagtgagctatgattatgctactgaactccagcctgggccagcattcgagatcagcctggggaacataggagactctgtctcttaaaaaaaaaaaaaaaaaaacagaagaagaaagaaatagttttcaggccaggcacagtggctcacacctgtaatcccagcactttgggaggccaaggtgggtggatcacctgagatcaggagttcaagagcagcctggccaacatggtaaaaccccatctccactaaaaatacaaaaaaaaaaaaaaaaaattttgctgggcgtggtggtgggtgcctgtaatcccagctacgtgggaggctgaggcaggagaatcacttgaacgcgggaggcggagattgcagtaagccgagattgagccactgcactccagcctgggcaacaagagcgaaactctgtttcaaaaaaaaaagaaaagaaaagaaaagaaaaagaaataatgtttcaatctatggacaggccctagacagagctgcctttaacacatctttttccctttccctcacatccttgatcccatctcagtcaaaaaggaaaaaacaaaaagttttcttacttctcagcctaagattcctgatactgtccccagatgccatacatgtattggcctcccagaaatcacccagtgattttctccccatgaaaagtttatatgtctcatgccctcagagtttttaactgcaaataagctaaaaaaaaaaaaaaaaaaaaaaaaaaaaaaaaaaaaaaaaaaaacgaaaaaaaaacctggtttggtggggaaatgggtgctcatgggttggcatttccattttggtaggcatctttttctaaggccatagctttactcaaagcccagtggaaaaagacatttaaaaaaaaataaaaacctttcaggaaccctcaagtcactccattggggtgaactcccctgtgacactagagaggtggtgaagcttggtggttagggcagttttctgagtcagaaatctcagcttttccactctctagtcttcagatcatgagtaacctcactggtgcccaagtgttccatctgtaaaatgaaataataagactacctcaaggaacctggtgggaagattaaatgggttaatacaggtaaagtacacagaaagtgcctgggaagtagtcaataattgtttgctattactattaccatttttacttttattagaattggctcaaaaagaacccaaagagggcaatgctcaaagggaagaaagggatgagaggagagtacacttaactgatttggttgtttagcttgaaggcaatgtccagctgcaggataaacagcatgaattggaaccaaggactcatctccatgtgggggaggggaatgtgaacagaaaacacgatgtcattggcttcaatttcccttggaattgcctcttcaatgtctcggatcttgtcacaatgattgggtccccaaggcacgaaccattttgtcttgtgatggttcttacgggcatccacacatttcaccgacatgtaggacactgccgttgtgggccctggagctgaaaagagaaagtttgtctgttttagaaaagccatctattgaaactactgtttctggttaatattctttccactgctgtgttccctccagcttttgtatcgccttctacaagtggggctcagcaatacttagggatcttccaaatctgggtgaggatctttcactgacctccagaggtgtcataacagtatctctgagaaccttcccattatgttttcaattgctgtgaaagaatacatttgtaaccagtctagttatacttccccacttcaaaacaatgtcacaaaaaatcaactgtgctacagttcccacctgattgaggtcttggagagctctggtgcttcatagagaacagtatctaaagtcagaagaccttagtcttcaaacctggattcgaagcctggttaaaaacctactgtcagtgaatcttgggtaagtcagttaaatctgtaatagcttcaggaccctcatctgagaaacggaagagtttctaagattccttttggctctaaaattgtacaacattgcttttgcttaagataaagaactaggggacaccagttagcttggtacctagcagagaatgggaactcaaacactgactgatacttcaaaagtgtactaaaatataaacgatgcacttcaagacagcaaagcaactttgaaatgtgtaactttaaaaacactattttgtgattatataatggttatatgattataatattaataacttggaaaatacagaaattttaagttcaaaacaacatttacccaaaatcccactagagggaagtaaccactgttggaaaatgtcaaaatgccatctgtcttttctatgactgtgtaattagataaaaagtttacacatgaattaaattgtgtaactttaaaatatacgcaaatattaacacatatttataaaatagttatatcatgcatagttttgtagtcttttctttttattcacttagaaaagcagagtattgtgtgataacaccagctctggaggcgacctgtctggtgtcaaatcctggctctctcatttttagttgtgtcaccacaaatccacactaggaaagttttgggcaaattactaagcctatctctgtatcggttttatcatctcttagatggcaataataatagtactgatctttccaagtcactgcatattttaaacaagttaacatatgaaagcactcagagtagtgcttgggcacacacaaagtataaaatattagccattatatcatattttctttataattaaaatctttcagttagtagttgcaaaatagtcaatcacacaatacaccaaaatcaacttctccttcatcagtttgtaaaggctatctataagaataatcctttgcctaatatgttttgttggaaatttctcctaaactttccatctgctatctaaatttgtttatgcacatttaaatagagaagttccagatcttatatggaatccctcttttatgtttttccccccatgcttttgtgtttagagaaactgaccttcttcatctcaaaattcaatagtcatctatattgacttctatttattttttgcaatttcattttttctaatatttaaacagttgatccatctgaaaattgctataagagatgcagtgaggttctagttttatttcttaaatatttaaattatagttgattgaacagaccctcccttttgttgatttatcatatcactgttaatctttatgtatgtaagcatgtttctgaacatctgttcttttccatgcattaaactgtcaattcacgggtcagcacaacattgctttgaattttataaatttattatttttatcaatatctgctagagtaactctcttccccaatccatttcaaatttacatctttttgctaggatattgaagattaaattaaatttataaataataaatatataataataaattaatgtggacagaattagcatccttccccagcgtttagttttcccatccaagaacagtacttgtttctccattgtctacaatctgtttttaaatttcttggaaaactttcattgttttctttatgtgggtcctactagtatattttaaaatagatacatctataaacctttgaaagttagtagttaaaagaaagtgtcatcaattatggtttatgtgtgtggtttaaatatgtgtatttctgtgcatctgatacttggtatattatgtttgcagaaattctctcttatttaatagagatcagatagcaatggagaaacatgaaaagcaaaaagaaagttatataacgggaaaaatgtgtattattaatattctgccctacttctaatgttcgaatccacattatttttctattctattaaacatctattttaatgatacatttttagtaaaatgttatgtttgtaagaagttaggacaatgcctattaatacttaccagaaaactcaacactactaagctctagctgaacatccttcatgtagaaggctgaacactgcaatacaagttgccactaacccctgctacagacgtttttctttaaaactcaaaactgtatcacgaagacctcacatctaatccatctaaaatcagacatctgacttattcttagaaatatgagtcaatcaaactttggttatcctgactcagctaaatagcccactgacattagaaaagccaaatggcacatttaactgaaccctttttaatgtggttggagaaataaacagtgagacaaaagtcatgaattctattttcggctaacatactcaaactgactatttgctgcagaaaatagttactacattttaaaacttctattcttccaaaatgaacctaacctttttttctttattttttaccttcttgaaaaacaagtctctcacttctcaggccaaaacgaaaaataactagctgagttcctcagctaagctccaaaaccacattccaaacttaataacagagaagctgaacactttatggtcacaaagtccgcatttttaatgaatgcagtgaacgcctgcctttttaggggcctgcattattttcatcctctcattagtctagtgtttcttctataaagaaaaaaaatcccagaaatactaatattttcataaatatcatggcagtgaacttggagaagcctcaagtgcatctcaagctatactgtgagaatcacaatttttttcacttgaataaattagtccttgagtctcaaaaatgctttccataacttcaaaacctgaagataattcaacattttccgtttttctaatagtgttcaaaagagaaaacacaagtattgcttgagaaagtaaacagacatcctgatattcaaacatggacagttaatgttcccccaataatatatttacagctcagtgcaatgtcctactccagctaaaagtgaattcccaagtgtttctttatatagacagcattatcacgtaaaccaaaagcaaagcttacagctggtagctggtcacctaccatagaatgtgttttcattagctatagtcaaaattttagctacatgggtcacaaattgtgtctagaatcaaaaaaagtttgatctgtctgtaaatttttttaaagtgtgtgggattaagagaaaagagctaaatggaggaagtttaaatcatcttcaacctttgaacaagccacaataacaggtatttgtaatgaaggccttacttagtcacttgcgtggttctagggattaatagagtttgtgtattcaagagggggctggatagattcaggtcaacaaactgagtcatgtttgctcaggtgaaagctaaaaataaccactccccagtattcctaggagagtaatgcaatattacccagctgcctcagcacacattataaatgtctcctccacccacccatagtataaggtttaactgaaaacaagtaggccaaaaactacttctacaccagaccaattcaatgacagaataatttggccaaaactaaatatgcctagtcactgtaaactggttaactcatggttggttaagatagccttgggaatatgcacagaagttataaaaccatgagctattcattgaaaatgcagtccattatgaattcagttctttttactttatcaaacatgaccattttattttgtctgtatttcaatacagtatttttggcctccacttttccactacagcacatgaattgtgaaatgtgattctatataacatttaatgttaaagtgatatgaaatcaataagacttctaacaaattcaaggtgtgaagaaatgtacaaacacaacctgaagtctctatgaaaattcagtggtccctcagttacacacattactatggctcacagtatattgtccaaatttgtcttgagtatctaccatgcactagacactgccggttctggagtaaacctgataggcaccaaccatatggaacgtacaaataacggaggaagcagacaataaataaacaatttcaggaaaaaataattttgatgaatgttatatgtaacctgacattccctgagaaagggcaacagtcagatatttgggaggtgggagaaatgaatacaccagaatgacagaaaaatccagtcatcgttacaacataaccttgaataaaaatgtaagtgaacaatgactaaacctgtagtacttcttttggaagaatattcattgactccagtcagcttcctgttatttcacttcaaatggctatccagtttacaaattactatctagccaaccgctagcatttatcatgcttaaaattgagtcaacattaaatcattagcccctattccttccagaacctgtaatttaagagttagagagagacaagacttggttgcctcttagaaaagttaaaataaaactaaaacaacaggctgacatgacacattgtctccatttaagccaacatagactatttatttctttgctttattatgagtaatgaacatttctttagcaatcacctaggagcattactattatgcaggtaccgtactaactaaagacagagacgaatggcctcccagacccccatttgctcacaggctagtgtgggaggctgagaagttcacaaagaattacaccctgattggaaatttctttgacagaggtttgcacaggatgctccagttgtaaaaagagctgagggtagctttcggcagggcttagccttggaagagagcaggtaatagccaagggagaatgggggatggccaaggagggaaggtgctgaggtagagatagaacatgtgctgggtcatagaatatctaaaacaatcatattttctgcagatatctgtgcttgaatattaaaaattaaaaagagatcatttaacggtgaaaactgtagtactactcttatctctgtgtccacccttgccttttctaatcagtggtataattctactagagtgccttggcctctgctcccaatcatccctgctgtactctatagagcaccataaagaaggaataataaacagagccacacataacaaagaacttttatttggcaggaatgtttccttttatgacacctatctctgccctgtaagtagccacaaggccagaccagagatctgctggaaggaggcggagtgagagggtagtcaggtgggaatgaagaagctccccgtcctattcccacaaatggccccaaagagcctttgaagtctcagtcatcaggtaataatagccttcctctaaattagaggaagaatgtctgccttgcaacaaagatgatatttaaagaataatctgctttggggtacaaggggaaggaatgcagagaatagaccagttgaaaaggtaattcctgtttataagaattaataatcagaacagcaccattttaaaaagtaatgacttaaagtaaaaatggtcaaagatttcagaaatgttttagagaattttatgtttacaatagaatttatctaacaaaaatgataggaacaatacacattgatttaaaaacatacaaaaagttggtagcagatactttctcctactgacttgagacattgatttaacacctgaaaactaatctcagttaaaaagctgccagcaccatctctccacctgtaaaaatgtgaatatttatttatattttataatttcattttatttattctctatcttgttccataaaacattttggggtactagaactggttattagcctttattttttaaaaataattgggactgatttcaacggatagaattaatgttggggcgggggtgggcagagactacaaattacttggtctatgtctatatcttcaaaagtttggggagcttatattctccagctattgctttttttttttttttccagctattgcttttgaaacaacagctgggaaatataagctcctcaaacttttgaagcaatagctgaagaatgaatataagctcccaaaacttttacctgatctatgaagttgaatggctcaatatccattttactttgaaatgtagagaaaacctccattgcactatgaatggtatttataagaactaaaaggcatatgcccaagttggttctaagctctgcctatctaaatatctctgcttgccttatgagaacttatataaaacatattgagcacttaaacccttgggcaattgcagagtgtgctttggattttttgagtatcaaggtggggagggtcgaaaagagggagaaagggaacacaggtgtcagaaaagactagatgaattcctgttatgtaactactttttcaaatgcccccaaagtacttatttaacctaagaaaatctttagctaagtttagaaattagctttaaatatgctcaattgattttccttagacattccacatgcctttcgccagctcaaaagccttaattctggttaaaaggaaacatgtgaaatatactgcacaacttcagtggccagatcatattaactggctgagctgtgaggtcttatgagccaaacctgcttaccattcactgaaagtcagttcctaaaaagatttcttaatatctgccataccacttatctaagttttgggtggctaattagaatgagctcttcaaaaagttcagctaaagaaagtgcaaatatttgcattaaattgacttagtacttaaatgattcagtgtgttaattcttttactgaaattgctctgaagttatagtagacacttatgctttctccaccacctactttgaagagaagattctcctatatttcaaccatacccattaaatcttactagcttactaaatgaagtattatttcacaattcaatctcaattactggagagctgaaagtgtgtctacagagactagaccagaagtgatttttacaattatcaaagctatgcccttgtgcatgaaatggggtacgctaagtgaaatgaaattcattcttgccagccactttcagtcagttagttatgctaacatctgttctaggaaagctaattttttttaatacagcagaacattcctttacactgaaccactaccaccaaaacacaaacatacatactacatagcagagttgaatgcaaaataatttgtaccgtacacacaaaagtcaagcacttatttaaaaatagttctttacaatataaacttatgaaattatggacattttgacagcaattttccaaaaattgtagcaaacacttgtaaatacattccgactcaaaaatattgaaaatatcatatgtttacattttaggcagatgaggattttaaatgcttcgcctacaacctcaattgttgtggagccaaagatgcaacagctttgaagaatagaagaattactctatatttgtcaggatctacgtggcaaacaagcgccacttggcttacattacttgcctggcttggatcccatggaatggaggagcattggaaccaagaggaaaaaaattaaagtgctttgggacagcgagccaaactcttacatagtatttgaaatggtgtggcaaacatgaaattattttaggctcaagattggtgctagttttttaccctctttttgaaaaaatagtaaaatgcacataaagggccctgccagaggtttagctcataaaatctgccaatcattggatgtgctaattggtgtagcaatccagtggtggcctggattaggactcaaaaactgacccttaccacccttggtgtcctgcagcaaagacagcctaaatcgaaaagactgatggaagtatatcaaattacgaatttctctatccctgaaaaatgcctgcaatttctgtttctccatcactccagaaatactcaaaacagcaaaaattaaatacatatgaagtgaacacaaaagacctccacagaaaaatcagtggctcatctgttgacgctattgctcattgctcggctggccagtcatctgggctaagttttgactttgggccagtgcttcaaaatcagcaacctttcagccaaaagactgtggaatgcagccaagaccacctgtggaaagtgaattatagcatctttaatttactaccttgggctatgatgtcagaaacccagcatggagggcgcaccagttcttgtgtgggaaatctctcagagcccccatggaggcccccaaagtggctctggcaaagctgtaggggtggaggtaacaaaaaaggggacacctggctctccttcttaaatcagctcaccatgggcacacatttatattggaattttagggtcagaaaataccaaaattaaatcttctagaagaaacacagtcagtggctttgctctaaagtgcctattacactctacaagtttccaacatttgttatttaaaataatcagacatttattattcataaattacatatattcttttatcaatattattgttaataataaacatgaacaactagtaagtgaattgcaaagaactttcacatacatagattatcgaatccacctagttaacaagtaacataattagcaccattgcatattcagaagatcagtggtttttgtctcatcagtaaatagagttaggactggaacccaggtctgatttcatatctaatgctcctttccaatacaactatctgtttatttattaacggttactatttattagcactctcagattacctgagatagttgcagagctgagggatgaatgaagacgactgtggccataagtagcttgctgaagctccacaggcaaggcactaccagcactgggctgggtgtcactcaaagggagccagcaagatagcttttctgggagacttacagtcagggacagagtacctctaagacttccataaagaaatgatggagtaataggctcatgaaaatgcactaaactcccttgaatctgataccctcccagtttttaccgggtcttggttatgacttcatattgcaggtaggcagtgtttaggatgttagcctagagaagatctgactcaggaacacagcgctgccatggaagtctatgacagcacttgcaggcatagtgagagacaggaattcaagttagagaaaatctgactccagagcaacctatggaagaattacttataattcaggtaggcaaacaatggcacagtttgactcaggaaagggtgggttcctcaaccatggaaacatttgggaagtaaatggatagataagagcaagagcctgaactaaatataagttcctctcagtcacaccaaaataagtctcctatccatgcatatggtatgtcagggaatggagaaattaaggtccaacaaagagctgcatatagtttattgatttgttttctattttctgaccagttccagataaacagataaaagcaattaaagtacagggcattctgaatggtcaaaaatttagtattgtacattgtaagttaaggctaagggcaagtaagacctgttaatgtctttatctggaatttcacaaatgccaagaataatcatatttccttccttgattgattattcaaagaaaacacaggcccttataatttgcaaatttcctagaattgagggtagaggtacattttaagggtaacttgcagttttaacattcacattcttaggaattattattattattaatttttttttttagacggagtctcgctctgtcgtccaggctggagtgcagtggcgcggtctcggctcactgcaagctccgcctcccgggttcacgccattgtcctgcctcagcctccagagtagctgggaccacaggcgcccggctaattttttgtatttttagtagagacggggcttcaccgtattagccaggatggtctccatctcctgacctggtgatccgcccgcctgggcctcccaaagtgctgggattacaggcttgagccaccgcgcccggccggaaatatttttttaaaaaacattgaaatcacaaaattaaatagtctatgcaattatttagtattttaaatttcatcagttttaggttctagctcaagggccgtctctccttcattcaatttgttaaatgcctatagtgtgccagctggaggcctcctctgattttccttcagttgacaaaagatccttacttcctttggtgccagtatcacctggtctatgtctttattatagcattctactttatttgcaggcatcacttctgaaccctacaaaattataagctcctaaggggaaggactacatcttattctgccttgtgccactaagcacagaaacttaaacatgcaagtcctccagacctgaactgaactatttattatatggcttttgtgtcataataaacatattaatgtaagttatgctcaatgtaactaacaaaattttatcaaatgcctactaagcatcattttttaaatgccatagtggattaatccttgtcccgcctgtatcaaagtacacttagactggcactcagtgacagtttgggaagaagccagagctgccttccgtgaggtcagtctcccaaggtcacacatgtgctcatcagagactcacttcctacaaatacttatgacggttcttccagatccgtgtcaagcaatatattaaatgaaatactgaattttgaagatcaaaatgaacttttcctaaactataacccaatccacacaagtaatttacacatcaaaagaaattagatagtaggcaaacaaaacaatggtaatttttttaaaaaaaactgctcccaaagggtttgtggccaacattaatattgcaggaacatgtttagataactgctgttcagcatagttcctggaaacaggttctcaaagccaggacttacagttatttaccttcttccagcactgccctgagggttttaaggcctaaatgaatagaaagcaaatgggggacaaaatgaaataaaatgttcacatctcagcctttagtgtatataactaatgtttgaagattttatgacaaaatgtgtcttcttaagaacacatgtagggaagattttggccatttctttaacaccctttaaacagtacctaccagagaaaaagcaaacactcccttctaaaagcatcaatattctacttctgagatcaaaactacaaaacaggctcagacagaaacctgggcaaaggaaccttctgctgcacgtatgtactatttcccagagatgtaaatgatttttttctctctgccccagtgaatcacatatgaaagttctcaaagaattagtaaagaaaaatggtgaaaatcttcttggtgttgaaggaacagtggagtgtagctggtatcagaagttctgaagtgactcagagattcagaagggtgacaggcaggggcagtttttactagaggaaagagcgatgtaggatgaacaatttactgtccctgttgattcacataggatgtaagtacaagagaagtcaaggatgtccccaaatttcttgcataggcagcagatgagtgatgtcattcactaagacaggaatcaaagaaaaatgaatgacatgtcatatcacacgtagaatttgtagaagctggagatgtatagcttgtttaaaaggggggtttagtatggagggttgaagataaaaggtcaaatatgtgaatgactaaatgtggaggaggaattagatttaccctgagtggttccaatcttgcaagttctcaggaaggaaatctgagatcaataaaatcaaactggcccacagttcaccacaccagttgaagaaaatgagctgccggcacctgtgtgagtggaggtgctcctcagttaacacttggtgagtgcaaagaatgcagagggcatttgagcaccgggtagggatggaaaggtgacttttagggtctttgttatcattattattctatgggcattcttcatatataatatttagagcttcgattctgggccacaagttgatctgctattcctgaactactacaaatttgagcataagaatcttggcagaataaattatcccaggactcatgattgctgggttctagcaatggatatgcattaatcaggcaaattattcaatcaatcttgggccttagttttctcaactgtaaaaggcagtatttaaactgttaagcacttttaactcagcaattgtaggattctaaaaagaatgtatgtacttctacgttatgatgaaagtcactcttttaagtttaaagaaaaagttcctacaaattagggtcaatttatattccaagagttctggctgtccctatcaggcccctcctccccctccttgtccttatattttcacatctgttagaagaacagatcttaatggtcctattctcgttctgttactgtttgggatctgaatgtattctgagtgttttctgtcttccaacagctggagagatcaaagaactgttcctaaaagcaaggacaagctacagccaactgcatatgtaaactttcatactgatgtatttagcacagtgaattatacccccataatttataatatgagaaggtaggtctaatccaataataataaagacctttaggagaaaacaacaaaaaacaccattccagcttccagccagtggtctgaatactcacagcctaatacaacacaaagacattccaatacaatgaaataatttggatcatgtccagcctctattttttaggatgatagaaataagctcaagagagctaagtctatttattattcagaagaaatgaaagtcatagcatacacttctaagccaagagatcattgacaaaatttgctaatgaaatcaattcataactttctttcagattttcatttaaacggctgggttcctaatatatttcaaaatttacactgattaccctctacaaaaagtatgtcataagagaaaacaatgattacagagtagcaagggacttactttcacaggaacggtgctttatgttgctgaaggcaattacaaaaagagagtaagaaaaattaaaagcaagagctagagctcagaaaaacttgggttcaaatcccaactctgttactcactagcaatttagtggggcagcttacctagccttgtagaatgccagtttcccttttgtaaaagtgtactaaaaggtactcgcctcctaaatttattttgaggataaaatgattaatataaaaaccctattacagtaccatgaaaatagtgaagccttaatgaatgttagctgataataatagtgctgtcaacacatgagaagaattagaatctggtgggagatgaagacctactccatgttctctgttctgtcttcttgccctgaggggtgtgttcatcaatatttaaggaactagaaggtgtgcatcttggatgttaaaaacaggggctcccctcacctatcagtgaacagccccaataccagagatgattctatacaaattttaactggaacatctaagataaccctgagaaatatcccaggcatatcttaagcagcctgttatttgagggaacacagaattaacccttggttttatccttagaaaaatgggatgataacatcttttttcacaattatcttcacaaattattataaaatagttatggcagagcaaaaactattgacatgggtatttgctaccctttcccctcctctcttcagataaagagaatgctggttttgcctcttctgtcacaaccccctcacctgccccccgatgaggattcaactattgctagatggattctttgagttttcatgatgcacaatcaaaagacaggggataggtagaagatatgggcttgagctcggcagggagaggggggcggtttaccagcgggagtgttggggagattttggaagagacgttagaaacatcaaagtagatgggaaagaaaatagggattgctagaagtactgctacagattatatatcccctttaccatgctttgacagttaaagaacagaagttgttaggtcactttaaattcacctttggttgactgcctgtttctttgacagaatccctacttggagactggaccaaagaggctatgtcttccatagaggcaacatgagaaagtaagagaggtgcaaacacatcatgcaaacgttaggcagaatttattgtgttcatacatgacatggggaacattgaaaggattgatgtcttagaaaggcgtgttaggagtgtgggtctagaatgcataaggttagagatatgcctgcactgggccatcatcttattttaatatttggtccaaattctgggcttctcacaatcagagagctatacctaccaatttcctcttattattcttggctgcccggtccccatccctctactcagagatttctcaagctttgcactaatggcattttgggttgaataactgttgtgggggtttggcttgtgcactggaggatatttagcaacatccttggcttctacccactagctgccagtagcatcttcatccccactgctggcaagttcagggggggtgtgggtgggggaagtcttctccaaacattgccaaatattccctggggagcaaaactgcttctggtggagaacctctgctttaccccaatcatccaggcttacaagaaaaattcatactccatcaagccattctacaacacttcattttcagagtttccaactacagagattccaagttctcagcaattcataaccattacagtttgcctcatgttacactgactgcatcaggctgtcatttagaaattataataatggctaccacttgttggatattttttatgtgctaggcattgtgctagggacttaacagggtgattttcattcttatacagaagtaagtgtggccgggcacgttggctcgtgcctgtaatcccagcactttgggaggccgaggtgggcggaacacctgatgtcgggagtttgagaccagcctgaccaacatggagaaaacccgtctctactaaaaatacaaaaaattagctgggtgtggtggcgcatgcctgtaatcccagctactcaggaggctgaggcaggagaaatcacttgaacctgggaagcggaggttgcggtgagccaagattgcacaattgcgctccagcctgggcaacaaaaatgaaactccgtttcaaaaaaaaaaaagaagtggtagatattattatctccattcagagatgagtaaaatgaggccctgaaaaattaaaataactcatccaaggtcacagccaataagtggctgaactggggtttgaacctaatctgtcccaggtccatagtctctccttgtctcaggccacactgtttctcctgatgagaaaaactaatgcagggatacacaagaaatacatttacccaaagttacatgagttcaaatggcaattccactgtatggactattgtagaggttgttgatctcagcactatgtggactcagcagtatggatgtctttgttctagggacatcaacaagctgatttttgaattatgaattttctgcagaaaataggaaaatggtgctctcctttaagtagaaacaacaaacagtagctggttgccatggtagcagaggtaaacttaaccttgactgggaaggcaatcaccagaaagggacagcaagtatggtcaggagtctaaaccagaccaggggtattttaactggagaagagaaagtcaaaggagagaaatgatagtcatctttagttatttgaaaggctactgtgtaactgaagtgaagcatacattcaagattattctaaatggaaaatccagcattcatgagtggaaattacaatgcagtcatggaagccagttttccactgaatgataagaaagaacatttaaccatcgtaatgttccaactggattgaaaaactaaacaagctgtctagagagcaataggtcgctaaaatagaaagatcctaacaggaaggtcatctctcttgggagacccagtgtgggtgagactgggctaaacaaattctcaggccccctccccaagcaaaatctctgtttctccagagaattagtaaattggggttccctgttgaaaacagacaaatggaaggtccactgggcggaaagccccagccgctcatcactacaagaggagaggtaaactacaatctcacctgggaagaaaatgttgtttaggtgacacaaaccaaggggaggagaaaccttgtggaggatttttcccctctgttctgaatagatgatcaaggggtaaggcagtaagggcaaaaccaaaaacaaaacaaacagaaaaaaacccaccaagaatcaagcagctttctgctgtcttccaaccctcagacactctgatgcctctttcttggaatgtaccgccacctcccactgctttggcctaaagactgcatttaattttaaaaagaaaataggcaaccatccagctaggggacagttagagtaacagttgattagtccttttctaaacactgtcttttgtttcattgctctttatttgctgtacaccaacaattcattaaaaacatctcaccactagatttagtgaatggagaggacaggtctaaacccaaacattcctcttggaaaaccgactacattgtaaatttgcagacctgtccaggaaagtaaaactgttacaaagtcaacctctactgaggcacacagcctcctttgtaaaagaaaaaaaaaaaaaagaggtgctaaaaaaatgacaggtttttcttaaaaaacaacaggtttttcttaaaaaacaacaaaatcttattcatctttccatattcagcatgaagaacacctaagagaattttccctatcgcctcatctccagggcactcaaagcatttacaatctcattattttatacaacacccattaagtgggcaccaaagattattacccttctttgatttctaagaaagcaactacagaaagtttaaacaagttgcccaaggtcgttcagtaaattgagatgcttggattttccattcagtgattgttctagggacatagtgcaaagtgactgaatcctctaaactcaccaaaacccctaagtcttacagatctcttccccatttctcaccactcatgagattttcatcatctaatcacaaatctgccaccatgtggatcttggacatgggtatcctaccaggccagtgccatgtctgcaagaagcctggtgctacacctgacagctttcaaatcaccatcaaatgattcctttatctagtgaagttgattctgcctggctgcatctgggaaatttttaacccctcgattagccattgcacagttggcttaacttggatgagacagaggacaaaatagtggtggtttaaaaaaatacctcccccattctgattacaaaggaggcatgattaacgaagtaccctttgtatccgagctccattctaagagaaagagaaagagctttccttcccccttttttgatcgctgagtcttttcctacttgtctcatcacccacacaatctgttcacagcccaaacagacaatccagccagtctgtggagagttcctaaaacatttatgttgtgaaagcagacaggatgaacaggacctcatctcgacaaaggatgatgggacattcagcaaaagagttcacgaagggaaatacagatggagtcccagagctgaatgaatttgcccacaatgtctaacacaatgccagcccttatgggtacttgtaaaccttctggtcaattcacagccacctccaggttttatcccccaaattccattacttttagaacaaagggttttaaaagaaaatacaattaacaagttaaggaggtccaaatcagtgctttaaggatccttcaatttctctagacctttaaacataaaaatagcaagttagatgaagattttagttccaacactaccagatcgggagttgacataatgcacataaaatacttaatacattgcctggtacatactaagtactcaaataatattacctaatattttcatcttacactgctctattttattaatgatgtttttatatatgtcattgcctgtctactcagctaaatagttccaccttatctgtttttggtataatccaaaagataaatgccttcatataattatcttatttaagctttcagatctatagtaggttacagatgagacagtaaaagcaagactaggtctcatagctggcaagtggtagattcccatactgagatctcaactcactaatttaacatccagtgctttatttcaataacaccacagatgaacagattatcatctctcgtgcctctttgtattcttcagaatttagctaagcgctaagatataccttaatgatcatctaaaataaatttctaatgataggtaacctaacatgtctgaagatttattttagtgcctttaataaggaagaaaagaaatgggtggaaaagcccaaccatacttggctttgaggaaagacatgcctctgtttttatttgccaagggaaagcattaccaggtccatttagaaagacaagaggaagtaaagccgggcgtggtggctcatgtctgtaatcccagcactttgggaggccgaggcaggtggatcacctgaggtcagaagttcaagaccagcctggtcaacatggtgaaaccccgtctctactaaatatacaaaaattagccaggcatggtggtaggcgcctgtaatcccagctactcaggaggctgaggcaggagaatcacttgaacccgggacgcagaggttgcagtgagctgagattgcgccattgctctccagactgggcaacaagagcgaaacttcattccaaaaaaaaaaaaaaaaaaaaggaaagacgaggaagcatgagggattcaatgatataccaaagagataaatggggctagagccagaactcttgatactctgctcatggctttctgtattaagttcattattaatttggcaccttgagtgagatgaatcttgccttggattatgcacatcaagttgtatttcagatggctgtcccatactttaaaggcccataccaaacccccatgtatcaaaaaaaaaaattatctgatctaaaaaatgcctagatcccttagcccttaacaacaaactgtcttattttatggatcttgtcttcccaaatttaagttgctggagggcaaaatccatgtgtttactccttctgtagcccatggctaacctagttcagaacttgtagcaacgtgtgctgctcattgcttcctcggcctcacagccttctagatgtcccaaagaaacctcgagtcatcataacatctactgaatttcccaaccatccccagcactactgctcggcttgggcagtcattaaagcttctcttctgccttcaggatcttcatttcagctgctgggacatcctgttgccatccatttcacacagacatccagcccagcaggaacccgtgttgcaatgagctttgcttcaaagccagcagcctggccaagttccaggaattgtcactaatgatcttcaccagcaacttggtgctcaacagtgatctctgaacacacacacacacacacacacacacaccccatttccaatactgctctagttagaggagctgcctaacagaggttggttccataacttattttattctttaattgttacagaggacttatttcatcaaaataagctaactgtccaaatacactctgcaatgcagcagtggcctccaccaacttactccttttttttttttgagatggagtctcgcactgtcacccaggctggagtgcagtgttgtgatcttggctcactgcaacctctgcctcccagtttcaagtgattctcctgcctcagcctcccaagtagctgggactacaggcaggtgaaaccacattcggctaatttttgtattttttaatagagatggggtttcaccatgttagccaggctagtctcaaactcctgacctcaggcctcccaaagtgctgggaccacaggtgtgagccaccacatctggttccaccaacttatttttaaactgaagaaggcataacaagtgtatcagtttcttttggttgtaagagacaggaaagcctgctcaaagatacttaagcaaaaactaaattagtaagatgatactgaaaaatatctagagataaagcagtcttctagtggttgttttgagaaatcagattatgtcaacagatctcacttctctacagtcattgaattccaccctgtattttattagcttcattctcaggcttcattggaaagactccaacaattccaggcttatattctgtgagttgaaattcagtaagaaaaagagaggacatctcttcctggtagcctccacacaagtctcagaattcactctaattagactaacttgaggcataaatccaccgtggctagtgcttggcttggtcacatgtccatcactggaatcagaagtgaagattctcttaaggcacatggactgagagtggggaaaaaaatgctccacaaaggagattcaggcagatcctgctgccaaaacaaataggcgaaacactaggcagccaaaaaacaccaatcatcctctccaataaatcttccttcttttcctaatctccaagaagttgtattactgggatgatccaactttgaaaatagtatattaaaagaaaggaacaaccacgcaagtcatataaaaatatatgtagccagtaggcacatgaaaagaggtttaccattactatcaatcaacgaaatgtaaattaaaagaataagatattatcagcacattgggaaacattttttaaacaaaagtaatcaccagtactggctaacatgcaaagagatagacattcccagatttggctaatgggtgatatgatgattatcactgaccatcaaaatccttaaaaatgtgcatttcattttacctaagataaattcacaaaagtgaatttactaaggaaataataaaggatgtacataagaatttaaatacaaagaagatttctccagtattgtttataatagccttaaactggaattattctaaatgtccaacaatagattgagcaatttaattttatccatactatgggttatcatactgacactaaaaataacctttcaatgcatgtttattagcatggcttaaataagtagaaaggcactatacaaaagaattaataaagtgggcaacaatagcatcattcactaactaaacccagtaaattagtttcaccctcatctcctaggcactccctggttccttctttaagatttaccctggggttctaaagacccagattccacccggggaaagagaaaaactctggacaccctcagcaggctaaaatgtgttgaataaatatgtaaagagagaatcaacaactgttcatgggaatggcttgctacacagaggagggtgaagaagatggaccacaactgtcatttacttgtcctggaagagagctcaaaaagaaatgtttggccaatacacagtgatttctatcacaagtagttcatattttttaaaactactcttttttcttgttcttcaacttgtcataatgtagcaattaatattcaaatcccgagttattccttccacaaacatagctactgccttgccaaataaaccataccacaaacagttactccccatctcagttttcataagtttaaaatgtaaatatccctgatggactggcctatcttagagtgttgttgggaagatcaaataagatgatttctactaaagtaccttcaagaaggataaaagcactatacaaatgtgaggtatcaggtgtatcagtgcattacgcagatttcacaaacacacaacagagcatgggagagttcatggcaagcctctggctcctccattaccctcatgtccttttccctgcagtcatttcagaaaaccagatgtttgtttgcaaagtttctctgcagcaaaagggcaggccctctctacattcaaattggctgaagctgtgtttctagctgttgaaacttagacaataatgggggagatgccaaaattaatccaaaaagcagacaggcacactttacagactggagccctgagatggaaaaaggcagcagcatgaacaagtagagggttaatggttttcatattatttaattcaagccgcaacaatgacagattctaaagatataaacttctgagagtgagcattctttcagaattagtatacaggggtcctattagcaatattttatatactccaaatatcttcccaaaggaaatcactgctgaaaaagacaaagttctttgttggtagggctgtgcgtttataccatggacttaaatacttttcttctacagtctcctcattttaaaaaatggcaaaaaatttcaataaaacatggatggagcaataagaagtacactgaagttcttaaatgcccttctttttaaatccccaccccaattacgtccctcccttgaggatatttacagtcctctatgacacatgctctgtaccttcttggttcaaggaaaacacacctacagcatttcaaattaactactgacccttactctcacactataaacaaacccttttcacaatctcaattgcattgtgtccacattgattaaagcttgaagcctggtgacctcatgtggtgttaacttctcccatgcaccaacagcattccgcctttctactcaattaccccctttggtgccagaggatcgctacccaatgaacacatacaatggacttctgcttcattacactaaccaacagcaggatagaaataagcagaagaggaataaacaagctaatttatcatgaggacagagcaagctttcaccagtctcgccatggaaaacttcagtggttaacgggaacatcaatagtctgggggtgatgtttatgatcttacagattatggacaaagccataacagaaccccaaactgactgaagaattctgcagattggcaggtgtgaacacacgcacacaaaacccatgccttaaaactccggggtcctacataaaacctactcagtaattattttgggaagcataaccctgggctttggataacgtgggctgacactctggtaatttgctccaactgttcagcttaactgtggggcccctcttatttatctttgacaaggtggtcaggaggaacccagcccctttgtgagaggggtctggttcccccaccgccccctgcttcattaggcatggcaaggacacagcggttgattaaattaacaactttggagggcttcagtcccagttcccagacattagcaccatcatccagaacaaattaaaagtctcacagcaattaagcagattttgaaaatgaatttcccatggttcaatggctcaaccacaatcttgagttaagtatcagagaagagtattgaaggaagagaagaggaactgactgctgaaattccaaagtaaacatacaactggtagaagcagcatacacaataaacttctgagcctctgctaagtaggcttatacatttcttttatagaaaattggaaatattcagtcacataaggggaaagaataaaacattaacatagaatggttgtatcaaaatggtggatttttttttcttttttctttgtttttaattactttaacatcattttattcttgttcaaaaatataaatagatattgagaggggacaaaaatacctacttccagtcacaggcttttaaattcaaacaagaaatcgtacatccaagtctggaactggaatcatctatatttctctgaaccagtacaactaggttcacagcaggcaaagaccttttatgccagcctccaaagaaccctgggtgggtgatttacctctaagaactcatttctggatcaaaagaataagattaatgataaaatcatacctatcacattctaggtgtgtactctttgccaggcactgccgttttgaggccttgtcatacttgcttccttccctttcagtttacatatgctcctttaatccctgttcccgcctcgcacctctgcctggctctacttgcaagtcacaggcctccgttcctctttgcctgcaggcagacatttggcacagcttgtgtgcaggaacctggaggaatcctgaaggaatgtgcgaatgaattcattcccactcaccagatctataagctgaagacagtggaatgcagaggtagttacttgaatgaactatattttcctgtcaagggcatttataaaagctgacatcataaatacattattggtctctaagtacaactgtaaataaatctacaaaattcttagaaggataactttcaaagatttgtttttcatctttaaaagtttatagaaaattaagcaaactatgtggctcttctaaaagaagccccttcaaaatagccctcacggaacagaagaaacacatttacttcttaaagacagtaaatctcaaaatttgcattacagttcaacagttccatttggatattcaaaatttggaaatatatatacttctgtgtgttcccttcttcccactaaactttaatcaactagtatagacaaccagccacagtcaattatctggctttatggccaagtagggaccaaaatatataacccagacataataacaatcagcataacagtaggcataggtaatgaaactctccgctagtggtcagaaagctcagttcaaaccttatttctcactatgtcttccttggaccttagtttccacaatataatggaaaaacgtccctttccaactccaaaattgtaccattttagaaatgtaagcatgtatattatgaaggtaacacaatcttttatgttcaagtgaataataaaaaccctcctcccatttaaataataatagcctggaatataatgttataaaacttagggaggacctcaaagccttaaagtagaagcattttagttacctccacaataggtccaaaatgcaaggcattcatctattcacctcttcaacagatattattgggtacctacattgcattgatctgtagtaacagccataaaggtgagtatattagaccatcattattctcatacagcttacagtttgacagaggttatattttaatcattattttttgtttaaaatttcttataaactataattctagctaatgtttcagaagtaattaatattttatttttaaaaatcatttttcctcaaagtttgactttaagaagtctttgtcattcacgttattatctagaagcaaaaaaatttcccagtggatgatgactccaattttataatgtaaaacagaagtacaactgggattcacttcgcagcaagcaaagagggaataaatctcttccacataatgagtgatatccatttaaaaaagtcatgctacctgggcttatctatgctctaaagagccatgaatactggcccagaattttaaaagacaaacatttagattcaaattaaatgttggttaaaaagaggaaaaacaacccaagttaattactctaatttaccgaatatatgaatgacctgcttattggactattggctagcatagatcttgcctaataggaaggctatcaagcagggtggctgggtttctaattttatccaatcaattaagaggcagaaataacctgcccattgaccttacgagacacaagttgactccagaataaacaaacaaacagacttgaaaagttaattatgggcaacctctccttcagagaaatggctcacatatattaattgatctaacacctatgtgcaggctcccaagaagatggaactcgttctctcatttaaatcccacaacccccgtgactcagagatttttggttcaggaaactgaggctcacagaatttaaatggttagtctaggttacaaagcaagtttgataacaaagagataaatcagatcactgccatttatcaaccataaaaccacattccatcagttattatagaaatccatcactttgaatggagagatcaagtttctcaaggattaagcttctcatttaacatgaactatcaaatggaaaacctcgagccaacacttatttttatagcgtgactatttctcaagaatcctgtaagaagcccacatcaagaggcaactttcaaaattactaaaatttcaaaaatttcaaaattacaaaagtaacagttctgtcaagtgggaagagttaatgcctttcctttacagagctgctttatgtaactagccgaagttttaacatagaaatattactgtttcatatatacattaatcttgactttgttaaaatcccaaacatactgctcatcgatctcctaaactttctctttttcaagaagtaggtgggggagggaaggaaggtattggaggaattcttctgatatctgtaaaaacagaaacaaatgctaattaaaagatgaccttagtgccctttcagtttaaaaatcttgagcatttacaaattatcttttttttctctttcatcaactattacccagaaataccacattctcatagagcaaagctctgtcctgtttgggcatgttcaaagaatagtgccagggatttaatactggcatgctcatggacctgcaaattctgaaattcagggggaggcatgaataaaaagatagctgaggtcccacagttgcctgtcacagccaagccccaccccacccacatcctcatatgatcctcaagaagcaaaacctttctgagatattctataagtgacagcaaggcccaatgtgcagtcttttcaaagcctcagtaaaaatcttatctatgacttcacttagcccagacacacaggagctaaaaggtaaaagcctggttcacacaagccagaactagctcaacagaaccgaaaaaagaaaggaatgtcttttctatatcttttccatgtctgaggcattctgctctggggcaaattacaacctaaataagaacagataaaatatatgggaactgagtaaaagaaatagaacctcaaaaagggctgctctgcctggaaagaaggctggaattcataaaacatggaacgtaacttttttagtgatcacctgaaggcaagcttgttaaacagagacttaaaagtcaagatttatttcagctaaattagatggtgcagaaaaacatagtgcttcgtgactctgctcagtttcaacaaaatgaaaagacagaggaggaagaatttacagtataatacttgcaccactcaaatcacaaaaatacacttgttagtcacaaaggaggggcccataacattgtaagccttattttggcaatgtgaattttctgcttgcaattaccttcaaagtgaagaaatggcagagacgaagaatgaggaattttgttgctgcttttgtatgtaaattcgaccaaaatatatagtgctatgtgactttaccccaagctcactagaacttcggaattatgcctgccacaaacatcctccgaaagcacaagaattagtcatagatttttttagtcaaggaagcctcagactgataaagtcttaaaactagacgcaaggactgtgctttggattggataagtaatgactatactgcgtggttttggtgtgtgttttttagagttttaaatttacatttccccaagcaggaggaagggaatgtaccacaccctcagcaagcaaggaaggaatttagttgattttttttaaattctgtagtgttccttaaaatccacatagcatagcataacattctatataattctgttgttccataagggattggctaagtatattaaggatacaaagggaagggggagatgacaaagttattgctattttattttcaagtgacagaaaaatcaatcgagctataagaagcaccagttgggaatgttctgcacattaactctttaatagccttagacagaaatcagatgatcttcacactgaaactctgaaggacatatatctttggggcactgagtagcattagaaactgcgtccaagccatggctccacctctaattgcatgaactgaatggcttccctttcctgggactcgaattccttctaaattaaggtagaacaagatagtcttgaaggccctttcatccttacgatttaatactgacaagctcttcagcttctattcaggacaaacaccaccaaagtgtatggatacaatggattcaagtagccacactcatggacagtgacaaaatcccacagctttagggtggaatcaagtatcatattggcctagaatgtattgatgctgccaaggtgtggggtgggggtgggggtgggggtggggggcaggggtgaggtaccactgatgtgtgaaatgacttgcctaatatcccagagacccctgaatcccaggcattcttattctgaatagagacttttaatcaatttcttgtctcatcctatgtcctcatgttaccatacttctacaagtctgtgctgccagtgagggttggcaaatcatcccaactcagaaggacagacttacaaaatggcataatcaagcttcactaacactgtatataaagtaaaagtaatagattgagtaaaagcatgagagattctcttgggagtaaaatgtgcatgctttaggagaagatttggacttgtgttcttatttgttagttttctgcaataacattaatatttatcatttgggggaggttcataatgaaatacttggttatagcacaggaactaatgttagaaagcaggatgacctccttaaactttcaaacccaaaccaagtaaggttttgggtcattcccattccttctgcctcaacagatctacaaatctgtaggtgttgggcaaagtggtggtgactcaaagaaggaaaagaatggataataaacagtgtcgtgtgtaagtttccccagatctaagaacagagagggacaaagaaatgtaggagagatggatttgggattaatcaaatggtttcagtgcaaagtcctctggaaatcacatctctgataggcctggctcaatgagacactccaacaagtgtcaagtcctcaagatagtagattccagtgatattttatgcttgtagcaatccccatgaggaaggagggctctgtttcacatcgcagttgagagagggagtcaatgagattttatgacttttttgggatcattgaggccacaggttgtctgcagagtcctagccaagtttctctccactaaatgacgctgctttgagaccagaagctctctcttttggagggggtcagccaggaccaaggcagcagttaactggcctccaaccaactttcatgaggctggccttattaaactaggtctgaagaaaaactgagtcaaccatttacagacttattatcttctttctaaaggaaaatcataatgccttgccaaaacaaatgtaataacttggccttttctttcaattacctctgctttcttggaaatgtgtatctgtggataaaacctctgagttaacccagggaattaaccagatgtttaagaagaccctgtgattcctgtgggccagcaaagaaagaataccccttggccacattatgagaatggagtactaaggagaaagggggagcagaaaattaaacttgaaggcccaggatttaaataggcatagcagatagaaatgttagctcagttttgggggattgggtgacactggaagcaggttttggaaatccaggcacaagctgtgtccttgaaaagacagtctcatatatttccagagcccttcatttcattttcttcagtctatattctacccccatcttcctattccacatcctcattacactcccatttcttcaacagctaccttcaggacctacgatgtatgctaaatccagggaacattcagagggcccactatctcgacaaatttcctattacaactctaagccatcttttgctgtatgcaataatttcctttggggagtgttggcatgtaatttctgaggttcagccctccctagcatggcccagaaacactgccaatatttacaatggctggtgtaggcagttcttatgtctcaggagttggggatcccttgttaaggaagtaataggccaatgatcagtaaccatgcagtgatatgagtgcatggtttggggaaggggtggaagcaaaacgaaaaggtgggggggattgagctttcatcttctgctctatctgtgtagaatcagtttcaccacactcatccctttgtttcccatagaaatggaaaggacaatgggaggaaggtagcattaagcttaagaatatggcttaggattcaatcaaggactgtgggcttgagtcttagccctctcatttactatctctgcactcttatttactatctctgcaacctcaaaaaaggttcttaaatgagcctcagattcatgtgaaaattgaagaaagtaaagtatttacttctttgggttgatgtgatcattaagtgaatctttacatgtgaaacgctttccatagtcccccagtcttccaatatgattactgcttttgctcccctacaagatttagtcagggatagaatgtggggggtggggggaagaggtggtagtaagaggctatagaaatttagtatttttatattataaattatacatcattattttctttaatttagcaatccttttagattcatcattttatgagaagaaaacttagaaaacactaaagtttgagatcattaagtttgagaattggcatgtctcaagctcctcctctccttcccacatccccatacgggcactttctctagaactgtgcagagctggcacatttattaggccaccatcacaacccttcagagaaaaagtaagacctaaatgaaatagtcgtgatcatttcgtgtcttgatgctccctgtgtctcattacctctcagggtctctatcaaaatcaagggctgcaaatctttcaatagagaaatctattagcatattttccaaagaacaaaatgtacctattcctgctgtcagggctgctgtttgtaggagtctctggtttaaaaggccctcgttattatgcatgggtgtgcatacaaacaaaacttctccgcatgggaaaagaattttcagctttcagtaagaggctcttttctcaattcctccaccatcactaccaacctacaccctctaaaaacctctccaacctccactgattctttctttcctctcctttgaaaaagtccggacttactgtataactacatatatgttaaaatcaccaactagagaaaataaaattgagtaatattcttgcaagtagcagaatctcaaacatttgatggttaacttggctgctttagtcaattggatgattcatacaattatggggactggttagaacttgaatggaattggttggactggcacaggcaaacttctcaagacatgtcctcccctcagccttggcaaggcactttttgggtctgtacagctggactccatttcatttatcatcacatttaatattttcttccttttgatgttacctgattataaaaatgagaaatcagttttagtgctattctcatgtttccctgcattcagatttttattcaggcctaaaagtcaaggttttggggaaagtgggaggatcacctaaagttgataatctaggctctgatgtccgattgactggagttcaatcccagctttgaccacgagtagctaggtaatcttgtgcagttttactagatctttctgcacctcagttcccttacatgtaaaaggggtacaaaaataccaatttgccaaggttttgtacagatgaaattagacaggctttggcacatattgcacattcaatacatgttaaacattttatcattttattaatatatctatttcaagatgaaatattaatataattagttgatggtataattagtaggggttctaatttcatacattctcgaattcccaataaataagtgaaaattatcttgatgctagaaaactacatcctaggaaatcttttgttgtaaacttagatgacgaggggctcttttctacccacagctcccctagtttactcaagctccatgtctcctctttaccaaccccgtgtcggcatgtagccccatcctgagcacacagtacaccctaatagatattttgcaaatcaggcaagtagcacacaggagttttaaggacctttatataatttcaacaaattcaaaattctaaatctccatagaaacacctttatgaggaatataaggtaagaaatatttctgcagtttatatggatttaaacattttaaggtcaaatcattgtaaaatgtcatgtaggaagggaaggcctgaagtctcaatctgggtttcaggcagggaacctgaaaacctcacaaagccacacataacactattagctcaaggaaatgtttctcactgtaacaggaaaagggaaagttcgaatagaagtctagacaggttgtactgaaagaacaatcagatgaaagagcaattcaagccgggcatcttgtgcctgtaatcccagcactttgggaggccgaggcaggtggatctcctgaggccaggagtttgagaccagcccggccaacccggtgaaaccccgcctggccaacctggtgaaaccccgtctctactaaaaatacaacaattagctgggcgtggtagcaggtgcctgtaatcccagctatcgggaggctgaggcaggagaatcacttgaacccgggaggcggaggttgcagtgagccattgcacttcagcctggctgacagaacgagactccgtcacaaaaaaaaaaaaaaaaaaaagagcaattagagattgttagcatgagcatgattacactgcaagaaccaaatagttaagttttttttaagtcaaatattgtaatttcaattactcttttaaaaaagagtaattgaaaactctttttaagagtttacaaaagagtaaattaaaaacatgctcttttaaaaaagattaatttataaggttgcacagtactcctacaaaccacattagatacttctagtagttaacaaagaggaaaacaatgacattttacaaaataaaaagcagaattgaatacagaaaaatatgacttaacatcaaccaaaaaccaattgattaatcttgtcaagattcttgtcaagattctcaccagacacccaaatactgaaggattacaactattgcatcattaagatatattaaaagaaatgcaacaagcttaaaatctaataaattggagagtaaacacatatactctgcataactgtaatttaatttcttaaaattctgcaacttccaaataaacaacagcagcagaaacaaaagctcacataaatgggtcacagtaaagaccagttgcctccacttaaacaatactagcacaatcgtgtgggctacatccttgaaagaagtagataatccatgcacaatttgagaaaattgattacatatgtgtgtatgttatatcttatacagtatacattacatcctcaacattaaaaatttaaaaaggccactcacataagttaccttttggaagaaacaatgatcttttctaaagaaataataattggtgatttgttgatacttacagtttatgtttggaatagtctcatttatgggtatgctgaaaacaatgcaacaattttctattaatccagttctgatcttcatactcttagcagttttagaagagctgagaacagtgacctgctttttcaaccattatatttctgagacatgactaatttgaagctgagcaaattgcacataatgggattcaagttcatgatttttagtctgcactctcttttcagggtacatggtctccttccctccctgcttctaccaccacccccaaagctgccttttcaggagctaaattcacccaacatgaaatcaaaagagaattatttttaagttttctgcaggcttatttttaaggaggataaagttatatttttaaaaatatttatcttttccttcaggtactaccgcatttttaaataatttctaaatatttagaatgtatttagatgtatttagaatagtagatgtatcagatgtatggtttcatagtggctcaaagtttttaaaaaagcattatataaatcagtgaatttataaataccctaagttctactatgtaagatgttgctttcagagcctttttgcaaaatcccattaaaggtttagcttacagacactggtgccaaaaaaaaaaaaaaaaaaaaaaaaaaaagcaagcaaaaaaatgtgtttttttttgtttttttttttttttggtaagaaggatgttgaaataggagaatatttaagctggctaaaccaaagccaattcctggaggctagttgcttttatagtgaatgtttaaattttctccatcaaatctagaaggctacaacgaaacaacagcctaaatgtcatgtacaattctctaagtactgaaagagttacacaattttagaaccgaaagggaccttaaactccttcctctaccaatgaggagcctgaagcctgctagttaactcacttgcctggtcactctggggttcacggattgttattgtttggtggggtggttgtttttgtgctgtatatttgtgtgtgtggtgtatgcagtactcacacccttacaaacaagagctttgccatttatattctccccttcctaagttgctcttcctaagtttactttcatcagcaaaaagagtgatcaaaaagaaaaatatattctggccagttcaaaggggacatttctttttctcacttggcctactgcagatatattagagagacacttcacacccaggacaactgactttttaagtggcaataacaatgagcagcggaggagttctcttctcactcgagagagcagaggaggtttctgaactttaccttgacttccagcctacaaactgttccttcaactactgtctccgcttgcccactttgttgctattctttccttagtttcctttgttttccagcttagggaagtttggtgggaaaatttttcacttacattttgttgatatttatttcccatatttgggtcctacccaaattttagatttaagagcaaaaaaaaattactgtttaagtgaaagaggaaaggctaagtcactgttcaacatgggctagatctgatctgaattggagacacagcctttgcaattgaggaaggagaggtaagcagtaaacttatacagtttcctccaagaagtgttatacatagatatttttcaaggaaattggaataaagcagtttattaattgaggggaagctagttacagttagcacctgccgcggactttttgaggttgtcgtcattaaccaaattcttcgggaaaaacaatctttggcaccacttactccagacaaaccctgtttggaacagacaagtgttctgaccctatagtcgctccaatgtccaccagccactcacgagtgcccttagggcttctccttggtggtagcatcccagaaatcctactagtttcagaagtgccctaggaagcctacttcttggataatgggctctgtctgcaaagctaggagatcagcctagaaaaagaaacacaccaacaaacaccaggaaactatgtgtaatggtttgctgcttgtgcaaaaacctcaaagaggatgaaggtcagacagggataataggccaatttaattctgaaagcacaaggtgcaagaaattttaattatggtctgccactgaaatcacacaagatccaatggcatctaactgcaactgctcatcaagggagacaagaggtgtaattgtaaccgctgcataatcactgtgagggcacagggaaggctgccttcagctcccagcagagaaggtattaagagcctcgaaaaatccaatacggggaaacgagattgcatgtagccaaacagaagctcctaacacaaaagccaacccgtgtgtgtgtgtgcgcgcgtgtgtgtgtgtgtgtgtgtgtgtgttgagggtgagggttccagaaagaaaatgtgaagctgtttggcccacactggggataagagattgtttgaaaactctgaacccttttctgttttgtggataaatgcacacagagaaaagagcactgtctcctttaggtatttctctccttgatgaagcttcacccactctcctttgtttaagacaattggcttggatgttaccgtgatttacagtaccaaactccctttaatttgttcccatcaaacccaagtctggagacaaaacgccaagcacacgactggaggtgcccaagcctgtgcagctctggcagcgacgccgccggcgcccccgggcgttttccccgcaccccacatcgcgtgggcgcccgtaaaggcacgcgcggagaaagcccctccgtggactccccactccgcaaagtttaacaaagccgtgaagtaaggaaaccgaacctcccgtccgcgcccgctgcaaagttggcattgaagtttgtgccgggatgtcccaaatcttgagggggcggggggcgcgagtgtgcagagaggcgggaggatggatgcagatggggagacagtgaggggaagggagtttttccgagtggacggtccgtgaggcggttttcttcacccggaagcctgtttgactcagagaggtccgggaggtgcacgccaggggaggtctcccggggcgggcgctgtcgccgaggaggccggcgagctgtcacctgcggggggctgtggtgggagctgagggcgctctcctaagcgccaaaagaggacggggacattcacagtcaccggctctcggggctctaagtagtgggggaagggatattcacgagtgggcaggaggccaaaagcaacacctttcggatacgcttttcccctccgacctctccaacttcccgcggcgctggtcaaggactccctcccaccccaccccatcccacccaacctcccggccgacaattcggacctgtccacggcagagcgtggggtggagtgcggcgggaaagcagagggcgcgaaggtcgggaccccaaattgcaaaccctcagcccctagcaaagacgaccaaatgcatttacaaccgtgcaagtatctcagccttgtaacagagctccgggtttgcgccgggcacagttccccgactcttctgttgttcctaataaagtcgattacgttgccctcccggagctgattggaagggaaccgagaggaaaagggggggaacgcgggaaaaagcgggggggggggggggcgagcaatcaactttgtaacccagcgcttcctcgcgcgatccgtcgccatgcttaagattcccacccccgccgcccccctcttgcctttcaagtggatactgaaactaggccaaaactttttcccctccttttctcttagccactagactggattgtgccccacggagccccatggagctctgctttcttaagcacaatagccggactaattagatcatagaagcaaggcagtgatactgtaacaagtagcccaagaggcaaagagggaaggggcccgaaaagacagaaagggggaaaagtttgcagctctccgcacttaccaatcaagcctcccaccagaaaggcgatgatttggaacacgagcagaatcccaccaacaatgcacagcttcttggtgctcatgttttctataattgccccagccatttttgcgccccccctttttcttttctccttgaaataaatgttttagggtgagctttttgctccctcctctcacacactccctccttcctcgcctcctttctgggcgctgcaaaacttcagaggtgctggagcgcggcgaggatgggaccgggacggaaggcgcccgcacggattcccccggcgcagccggctcgggttcccccaatgcccggagctgtgattgtggccgctccgccgcctgtggacgcttaaaggagcagggaagcggatcacatgacgccgcctccctccctttcttcctc

SEQ ID NO: 1082 - DNA, 9825 bp, Homo sapiens
aatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccatggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctctacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaaccacaaggtcttcctctgcgttctctcctttctggatgccagatgtgtgtgtgtcgatttatctgggtgcaggtctcagcactatgtacctaccaggtgaaactaaatcagtatactcaaaacatcacagcagggtccttaaactgtgtaccaacagtacctcagctaggccagctctaagtaggatgtctagagtaagacttaggccctaagattgtatcattattccaaatgtatgcctgtacatagtaaataataataattcaaacaaatgagcaataatgaacaatgaaatatcttcctcccacccaaaacctagatctgcagtcaccttccacagaaacaaaactgctaatatatatatacatattatgcatatatatgtatatattagcattattatatataaactatatatatatatatatatacacacatatatatagttttaaagctgtgggtggtagaacactttctaagtattgtcctatatcttacttttatcacttaaaataccttaaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataaatggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttcgttaaaaatgataatgcaaaagtcaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttcgttttttttttttttttttttttttttgagacagagtctcactccgttgcccaggctggaatgcagtggtgtgatcttggctcactgcaacctctgacagagctgtttcaacaagatactttgggtaattcaagcagaagtgtttcatggttcaagtgacaacaaaaggactagggctgggaagagtccattttctttacctctacacagactctaggacactcagcatcagtgacttactgagaatcatatcttttttatattacattttaatgtgaattttcattgaaatataacttatgtacaacaagccataaatgtatgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaactgtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgtttgacagtatctgatggaggtatgttacaatttcccactcttttggatatacaaatgcaaattaagcatttccctaatgactatgatattgaccatttttcacgtttattacctatttgggtatccttttttgtaaggtctttttgataatttttctattgtctgtctttttcttactgacttacaggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgccgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaaactcataaatttccattatacattattttattcatgaattacttagatgttttttggagggtagttttttgctattgatttctaatattatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcaaatattttctaccattactagtgtttgacagtttctgatggagatgtgacagcacttcccactcttttggatatataaagcaaagatggcagtgtttgggcagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggagggggaaaaggcactattgtctcttttccgccttagtctcctaagaaccccatttttacttagccaaaccaactgcctctggagaaaagaaaagtagttgaagcatttttggttatgtgtagaggtgtatgtcgaaaggaaaagcccattgacttggagcttgttttgctagtgatatcattgatcttacatatgtgagtattcatatcaatgtagtaggatgtttatatctggatgtttgcccttctgtgtgtttgtcttaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctttttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcatggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttggcagagctctgaggctggatgttgcaaggagaaaaaataggaagcccacagggccaagcttgggcctccttgtacctcctccactgtatacatacattttgggttcatatttttcaggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaacccccatcaacaatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaagaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcaggagaatagcatgaacccgggaagcggagcttgcagtgagctgagatagcgccactgcactccagcctgggcaacagagcgagactacgtctcaaataataataataataataataataatgatgataataaagtcactgaaatggcaagtgtgtgagtcagggttcactcctagttgaccactgccaaaagggcatggttactgaccagatgacacggtcattcagggaaggatggaccttgtagagcaggggttcccaacccttactggtccgtggcctgttaggaactgggctgcacagcaggaggtgagcttcttcatgagccagcattacggcctgagctcctcctcctgtccaatcagtggcaacattagattctcacagaaacatgaaccctattgtgaattgtgcgtgcctgatgatctgaggtggaacagttaccttccaaaactgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaagggttaatgccttatggatgcattttctagggccaggtttcccaagggggtaaagggcatgtcttttgtgaaaaggacctggatgctaaacaggcaaccttgtcccccatcaactttctccttagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttctttttttctccttcattttattttcccctccctcccactcttccctccactccatgacccccccttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctctagaacaaagtctccttgggggggaaaaaagttcatcttcaacccaaattcatttcaagtattaaatggcacagagatatcagttgtctctggaactagggagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagctagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgcccacttgctccccgtgagcactgcgtacaaacatccaaaagttcaacaacaccagaactgtgtgtctcatggtatgtaactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagccaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctgtttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacatagctgaggtaaaaactgaactatgtaaatgactctactaaaagtttagggaaaaaaaacaggaggagtatgacaca

SEQ ID NO: 1083 - DNA, 9004 bp, Homo sapiens
aatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccacggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaactacaaggtcttcctctgcgttctctcctttctggatgccagatgtgtgtgtgtcgatttatctgggtgcaggtctcagcactacgtacctaccaggtgacactaaatcagtatactcaaaacatcacagcagggtccttaaactgtgtaccaacagtacctcagctgggccagctctaagtaggatgtctagagtaagacttcggccctaagattgtatcattattccaaatgtatgcctgtacatagtaaataataataattcaaacaaatgagcaataatgaacaatgaaatatcttcctcccacccaaaaccctagatctgcagtcaccttccacagaaacaaaactgctaatatatatatatacatattatgcatatatatgtatatattagcattattatatataaactatatatatatatatatatatatatatatatatatatatatatacacacatatatatagttttaaagctgtgggtggtagaacactttctaagtattgtcctatatcttacttttatcacttaaaataccttgaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataagtggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttctttaaaaatgataatgcaaaagttaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttccctttttttttttttttttttttttttttttttgagacagagtctcactccgttgcccaggctggaatgcagtggtgcgatcttggctcactgcaacctctgacagagctgtttcaacaagacactttgggtaattcaagcagaagtgtttcatggttcaagtgacaacaaaaggactagggctgggaagagcccattttctttacctctacacagactctaggacactcagcatcagtgacttactgagaatcatatcttttttacattacattttaatgtgaattttcattgaaatataacttatgtacaacaagccataaatgtacgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaacagtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgttcgacagtatctgatggaggtatgttacaatttcccactcttttggatatacaaatgcaaattaagcatttccctaatgactatgatattgaccatttttcacgtttattacctatttgggtatccttttttgtaagctctttttgataatttttctattgtctgtctttttcttactgacttataggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgctgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaactcataaatttctgttatacattattttattcatgaattacttagatgttttttggagggtagttttttgttattgatttctaatgttatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcagatattttctaccattactagtgtttgacagtttctgatggagatgtgacagcatttcccactcttttggatatataaagcaaagatggcagtgtttggacagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggaggggaaaaaggcactattgtctcttttccgccttagtctcctaagaaccccatttttacttagccaaaccaactgcctctggagaaaagaaaagtagttgaagcatttttggttatgtgtagaggtgtttgtcgaaaggaaaaacccattgacttggagcttgttttgctagtgatatcattgatcttacatatgtgagtattcatatcaatgtagtaggatgtttatatctggatgtttgcccttctgtgtgtttgtctcaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctgtttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcgtggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttagcagagctctgaggctggatgttgcaaggagaaaaaataggaagcccacagggccaagcttgggcctccttgtacctcctccactgtatacatacattttgggttcatatttttcaggctggccactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcaagggaaagcatcactacacatcagcaggaatatcacaatacactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaagccccatcaataatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaggaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcagaatagcatgaacccgggaagcggagcttgcagtgagccgagatagcgccactgcactccagcctgggcaacagagcgagactacgtctcaaataataataataataatgataataaagtcactgaaatggcaagtgtgtgagtcagggttcactcctagttgaccactgccaaaagggcatggttattgaccagatgacatggtcattcagggaaggatggaccatgtagggcaggggttcccaacccttactggtccgtggcctgttaggaactgggctgcacagcaggaggtgagcttcttcatgagccagcattacggcctgagctcctcctcctgtccaatcagtggcgacattagattctcatagaaacatgaatcctattgtgaattgtgcgtgcctgatgatctgaggtggaacagttaccttccaaaaccgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaacggttaatgccttatggattcattttctaaggccaggtttcccaagggggtaaagggcatgtcttttgtgaaaaggacctggatgctaaacaggcaaccctttcccccatcaactttctccttagagctatttccagctccagtgctgaatgcatctgtgacatccccactcctggggggaatctggtcaccctgagctgtgaaacaaagttgctcttgcagaggcctggtttgcagctttacttctccttctacatgggcagcaagaccctgcgaggcaggaacacatcctctgaatactaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttcttttcttctccttcattttattttcccctccctcccactcttccctccactccatgacccccgcttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctccagaacaaagtctccttgggggggaaaaaagttcatcttcaacccaaattcatttcaagtattaaatggcacagagatatcagttgtctctggaactaggaagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagccagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgtccacttgctccccgtgagcactgcgtacaaacatccaaaagttcaacaacaccagtctaaccagaactgtgtgtctcatggtatataactcttaaagcaaataaatgaactgacttcaa

SEQ ID NO: 1084 - DNA, 9377 bp, Homo sapiens
tgggtggctctgaaaagagccttttgagttcacaggtgccccttcgagacgcgggccgggctgggcccacttgggccggacgtcagcctcacttgccctttgccttgtggtgactctccgtcttcttagggagcagtacggcctggatgttaggcaagacgccgccctgggcgatggtgactttgcccagcagcttgttcagttcctcgtcgttgcggatggccagctggaggtgacgagggatgatgcgcgtcttcttgttgtcccgagccgcgttgcccgccagctccaggatctcggcggtcagatactcgaggaccgcagccatgtagacgggcgcgccggcccccactcgctccgcgtagttgcctttgcgcagcaagcgatgcactcgccctaccgggaactgaaggccagcgcgggacgagcgcgacttggccttggcgcgggccttgcctccttgcttgccacgaccagacatgacagcgatagtagtcaccgagagaaactcctgcctggcgatcgggaaagtcgccgaaaacgccgctgcttcacctttttatagacagaacggcgattgtccacggagcactttgattggctcaagcaaattttgtcccgatagccaataggatagctcagccagaatccactcatttacataatctcgtctccctcgcattgcgcgccgcggaaaactcgcgaaccataacgcagcgtcatgcgcacagcctctgtaagtacacagtcgtttccggtagaccccgagcctaccgctctgcttgcgttctcgggggtcggtgtcggtcttgggtctggccatgcctgagcctgcaaagttcgcgccggctcccaagaagggctccaagaaagccgtcaccaaagcccagaagaaagacggcaagaagcgcaagcgcagccgcaaggagagctactccatctacgtgtacaaggtgctgaagcgggtccaccccgacaccggcatctggtgcaaggccatgggcatcatgaactccttcctcaacgacatcttcgagcgcatcgcgggagaggcgtcccgcctggcgcactacaacaagcgctccaccatcacgtcccggagatccagacggccgtgcgcctgctgctgcccggcgagctggccaagcacgccgtgtccgagggcaccaaggcggtcaccaagtacgccagctccaagtgagtccctgccgggacctggcgctcgctcgctccctccctccctccctccgcgggtcgccggctgctttgtctccaaaggctcttttcagggccacttaaccccgttagtgaaataagctgttttcccactgcttactgtgagttctacttaggggttttccctcagcacctatcccttttcctgcagatgatgggagaggaatataagataaagctataagatgtagcttggtcgagaactaccttgtagtgacagggtcatgtgcacataatttgccttttccaaagtgagacgatatgctacgggtgcggtcaatgtaaatctgctcaggagagtcgagggaaaaagtgttaactgcatattgagctcgcaaaattgtgtagtaacctgaaaatattcctaatagttttgcgaccaagcctcaccatataaactttccttccgcacctgtagacctccattctgtggttgaagcaatttttggtttatatagctctcttgtctcaatttggtattcctttcaggtactgtgagtctataggtatttatttctgggtttcaagacgttaaatgccatcagaattgagtaatgcaaaggctgctgtcatggatagtaaagctttttagtcaagtgctgatagacaattccccattgttatcgttgggtattttacaattttctgggcaagaaatgtaatgaaaaattaagtaagttttaaaggccttcgtctttgagactggatacctaaaacaatagtgtttcctaaacagttaaaacttatttaaccctgaagctttcgagacacacaaatatatacaaatatatattgtatatttcttaaaccccacatagttccactgatctaaatcactgggggcgagaggcaaggatagacaatctatgacacaacaccaggtgattcataagtttggtaaccactgacatttgattatgcagttgccatattccttagtaagaacctggtcacaattttcactcactaccccaggcaattccccctccccacaccccccttttttctgagaatttcagtgagatatacaaaagtttcatttaatcctttattaattccagactttatatatttttattaggatttaaaatacatttcaaaaagatcaagtgagaacagaagataaaagtaccaagataaaggcataatacaaacttagaaaatacatgttaagcatactgcggcgtcctggtagccccttgcttttgttcacttttttctcttatgtacctacataaaatcccaaatagtatcttccaggatgacacacttgctgtctgccccacccaattaaaaacagattttttagttattaggtattgtgctgaatctaccttattttattgccaaaagaaaaaaaaaaaaaagcttttcaaagcttcatccccaggaaacattttcctgcttttacacataccttatatggctctactgagagataaggcctaagcctgaaaagttaatttaaagcatggaggtaggggtgagacagaaagacaacagggaaaagttgagtttataaggtaagtatatatcttccttttaacagccacctgcatggcgttcggtaaataacctaattatatgtgggggaaggtagtggtcaacatttggtcctggggactgagaataagagcaggaaagcaataaacagctaactatgagagtgacttaatgtaattatattacctgtcaatcgctacttttcctttcttaccaaaattcacacaggtatgaaagcaatatgacattcaggctccattatgtgtatttgtgcacatcacttcccacgataagggagaagaaaagaaaccactgcacattcggataaaacatgctgggaatacagcagtaaacagaatagaaaaagtctacattttaattagcagataagtaaaaataagtgactaaatgtatattattcagggggccatatgtgcaattgctgttaagtaaagcagaacatggagtggagtagggatgacaggtttcatcagttaatacttgagcagagagctgaatacagtaagatagttgtaggatatcttgaggcagagtattctcagaacagaacatggtaagtacaaaggccccaaggcaggaacaagcttggtgaatgtgagaaatatgcaagctggttaatgtggctgaagcacagtgaccaagggaaagttttacagagatcacggaggtgcttgagggctggattatgtaggccattaaggagcatcacaggccactgcagagattttgtcttttaaatgagatagagtgctcttggagaatgtgactggagaggccgatggtagcagtggagatgcagagtagtagccgagatattttaaatgaaattgatttagtataggctgactgaaagagaaatcaaggattaattgtaggtttttacactgagcacttgaaaagagctgctatttgctgatatgagtaaggagtagtcttggaggaagaaaaccaagagtactgttttgaacaaaatgttgaagactcctggtaaatatcgaagtgtaaatatcaaataggaagtcagaaatatgagaatctggagtttaggaaagagaagggggttaggtttgtaagatctcatatcagtctgattcttatttttttgtagataatctaccctttctttctgtaaatgtttagaagcatgatgtctatgtgtgtatatatacacacacactcactcccccccgccaggactgcctcagttttcatctcagtatttgactaaaaccttctattcaacttcagtttcagccttagaataaccagatgtctaagtcaatgtcatttggggcatctctagacttgtgcaatcacaaaagtcaccattaccgctacatagtacgtattatgaccaatggatatcattcagagttctagtttacatatgctattatcaaacatatgtaagccttttaatgtaacttgggagtgaaattagtaaaattctatcaatttacataaattaattttactgtaaaaataaaatacattatgaaagtttctgtactaatgtctttgattacaatttttaaagtatttcccatttttttattttgaaaattttaaacctacagaaaagttggaaaaaaaagtacaaagaccagccatagtcccttcacctggattcaccaattattacaattttgctgcatttgccttatctttgtcttctcatgtacacagacagcctctgaaccatttgaaaataaactgcaaatatgttggcacttctccctaaatatggtggcatgtctcttaaaaataggatattctcctaaatagctacaatcacattattacacctaacaaatttaatgctgattcagtaatattaatatgcaatccatattcaaatttctccaattattgaaaaaattctatatagatgttgtattagtttcttgtggctgctgcaacaaattactacaaactcaatggttttaaaacaacagtcattctcttacagttttggaggtctgaagtacaaaatcaattttactcggtagaaatcaaggctgcactccctccagagaccttaagggagggtctatttccatgccttttccagcttctagaggtttatttctggtttatggtcccttccctctgtcttcaaagcaagcagcctattaatcttcaaatccctctctccttctatcgcctccttctacacttgactttcttgcctctcctataaggactgtggtgattacatttggggcctacctggataatctggcataatctctcaatctcagaatcacatctgcaaaatcctcttggctatataaggtaatattcacaggctgtagggattaggatatggacatatttgggagccacatttagcctgccacagccattgactactgttatgggttgagttgtgtccccccgaaagatatgttgaagtctaacccctagttgcttagaattttgccttctttggaaacagggtctttacagaggtaatcaagttaaaatgaggtctttagggtgggccctaatccagtatgactgatacccttataagaagacatggagacagccgggtgcagtggctcacatctgtaatcccagcactttgggaggccaaggcaggtggatcacctgaggtcagttcgaggccagcctgactaacatgatgaaactccatctctaccaaaaatacaaaatcagccgggcgtgctgacgcatgcctgtaatcccagctactcgggaggctgaggcaggaaaattgcttgaacccggggcacagaggttgcagtaagccaagatcatgccactgcactccagcctgggcaacaagagtgaaactccatctcaagaaagaaagtaaaaaaacatggagacatacatgaaaaaactgaggtagagattacagttatgctgccagaaaccaaagaacaagtggggctaccagacactgaaagacaggagtcttcccctagtgggtttggagagagcatggccctaccaacacgttgatttcaaacttctagcctctaaaaccatgaaagaataactttgtgttgttttacgccatacagtttgtggtactttgacagccccaggaaattagtacaactactaaaattttttgatttagtttatttaaaatttttaaataaaatttcacatctgaaaaaaaaccctggacatttttcctgtgatggtaatattagtctttagccttagtcaagtattaacatttggacatctgttccaaatatgtaattggagcaactctgtcctaattgaccctatttgacttgagacctttcatgaaaggtctttccttttatctaggaaattattattcctgaaatatttcaagattcaaactggtataagtaaatatgtcagacaaattggcttaactggaagtccaaaggtgcagcagggatccaaggttggctgaactccatgagtggctcagttccctgattctcccacactgtgtcctcctctgcatattgtctataatcattcttgccttcatacctaaagacagtccatcctcctgctgcctcttgaaagcaaataagctgctttcccaaaagataatagcatactacactcccctgctgagttagttgttactcagttcacttcctgaaatgttaaatgccaatgagtttgatctagattcctgaactaatcacagtaagaagcaggttcagacagcaattaaactaatcaggccaaccctaagaactgtgggtaaaatgcgtttctgggaaacacatgtggcagcactataacagaaacaattagaaaaataaatgctacctagtcaataacatacattataggactatgaactactaagttacacctcatgacaaacacatgagtaataaagtctagaaaaatacttaaaggtgatgtccatcattctcattgctgtgttcacagttcacaggtagaccctaaagacaggcttgtgttgtctttactgaaccctagatgcatctctcaaactgtcaactgcacatatccacttgaatagcaaagagcttctcaaatttcagtcggaactctggatctcccttcagtgtcccaacgaatatcttctctcagtgttctatcctaatagtaccactatgtacacagttgctcaagccaaaaatctaggggtttcactgttagctaaatcctgttcctcagccacacctattaattctacctcaaagataaaatccaacatttgtttccattaccaccattgcactccagcatgtcatttatccgttgtttttcacactttagcatatatcaccatcacccagaaagcttaacacaaataatggaacctgggaattttcatttttagtaacttcaagtaatgctgatgctgctggtctggagagactttaagtcttaatcactgttccagcccacaacactgcaacagcctcctaattgctttcctcgcttctattgtggccagcctaggatttacgatccccagagcaatcagtataatattttgaggttaatgaggctgtgtgattccaagtccagtgttcccaaagcagaaaacaaacctaatcaacctcccttgcaaattggtggtccttctcctcttcagggatcccaaactctggcttcagaaatcgtatattttgttgctattgtatggaacaaacccttaaactggacaagcttttccgagtgataactcttggggaaaaaaaccatttaatggtattgggtagattttagggtatctcaactagaaagcgcagaaggttatcggtgttaactcctggttatcaaaatcgaacttccatctacctccttaaggaattttcacatgagtggtggtgtaggcacgtgtttgtgaaccaatgatataaaaacctcaggtttctcgataccatatataaaagttgagctattcccttttaagtacacatctgagagcatacaatgcatttaatctctaccttcattttaccactgaagagcggacccaacctttgttcatatacacaatttgatcttacataaacttatcaaaattaacactgcgtttctcaacaggaaacaatctcctgggcacatattcacgggtacgtaaccaggccaaagacagttcaagagcagccctctaaggcaagccccaacctatctatgccatagtaagataccactatcaatctatgtaagcttacttatagcaatgcctatgtgaaaagaaaatagttatctgtgcttggtgttgtgtgctctcctaaagttaaccagacgtgaagccaaaaacatcaactgggactgacaacacaagaaagattctttaactgaggtggttaaatggccctgaaaagagcctttggagacaaagcagccggcgacccgcggagggagggagggagggagcgagcgagcgccaggtcccggcagggactcacttggagctggcgtacttggtgaccgccttggtgccctcggacacggcgtgcttggccagctcgccgggcagcagcaggcgcacggccgtctggatctccgggacgtgatggtggagcgcttgttgtagtgcgccaggcgggacgcctctcccgcgatgcgctcgaagatgtcgttgaggaaggagttcatgatgcccatggccttgcaccagatgccggtgtcggggtggacccgcttcagcaccttgtacacgtagatggagtagctctccttgcggctgcgcttgcgcttcttgccgtctttcttctgggctttggtgacggctttcttggagcccttcttgggagccggcgcgaactttgcaggctcaggcatggccagacccaagaccgacaccgacccccgagaacgcaagcagagcggtaggctcggggtctaccggaaacgactgtgtacttacagaggctgtgcgcatgacgctgcgttatggttcgcgagttttccgcggcgcgcaatgcgagggagacgagattatgtaaatgagtggattctggctgagctatcctattggctatcgggacaaaatttgcttgagccaatcaaagtgctccgtggacaatcgccgttctgtctataaaaaggtgaagcagcggcgttttcggcgactttcccgatcgccaggcaggagtttctctcggtgactactatcgctgtcatgtctggtcgtggcaagcaaggaggcaaggcccgcgccaaggccaagtcgcgctcgtcccgcgctggccttcagttcccggtagggcgagtgcatcgcttgctgcgcaaaggcaactacgcggagcgagtgggggccggcgcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgtcttgcctaacatccaggccgtactgctccctaagaagacggagagtcaccacaaggcaaagggcaagtgaggctgacgtccggcccaagtgggcccagcccggcccgcgtctcgaaggggcacctgtgaactcaaaaggctcttttcagagccaccca

SEQ ID NO: 1085 - DNA, 9377 bp, Homo sapiens; identical to SEQ ID NO: 1084

SEQ ID NO: 1086 - DNA, 1812 bp, Homo sapiens
ttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcaggacatctgtgacacaaagactgtgacacacccacaggtcgattaacatgaggacccaacacctattaaaacatccacactcctgagaacactaaaaaccaaccacctcgtcaggtcccacctccagtctagctgaatcaggaaacctcaggagaagcacctggaagcaggtttaacaagcgcaaaggtgactcttataattgggaaagtttggaaccaagacagggttcttgtcctggaggaagtattttcctgtggagaaggacctgtaaacagcctatgaagtgctcagctttcaccaagaaaagaaaaacatgggctgatagggttaaggaaacgtttgactgaagaggattaaatcctgaaggttagggatgtctttgggcgctggggtctctcaatcaccaaagatcgacattacaggccaggtagctctttgtccccccagaggactgtcctgtgccttatgcttagcactcctggcctctgcccattggatacttctagcacctcccccgcaacacacacacacctgacaacccaaaacatctacagatattgccaaatactccacagggggtggggtggtggcaatatatctccctgtttgaagtcactggaatggaagttaggggaggatggctaagtcaggacttgcaaaaaggctaagggacgaaagcacatggctatattagacaaagtttgtgacagacgcctgtaggtatatggtaaggaaaacagattaaaacactaagaaatagtaagaggtcggaccgagggtttctcatctgtatgggaaatctcatctcgttcattactttcagaaacaaaaaggaaaacgactttaaagatacaggttaaaggccgaaggggtgtagaaccaccccccgcctccttccctccatccctcccaaatatcccagaacgagtcaaacctttcgaatctcgtagcacagataacaagcaactcagtaagactggacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggatgtgatggtggagcgcttgttgtagtgcgccaggcgggacgcctctcccgcgatgcgctcgaagatgtcgttgacgaaggagttcatgatgcccatggccttggacgagatgccggtgtcggggtggacctgcttcagcaccttgtacacgtaaacggagtagctctccttgcggctgcgcttgcgcttcttgccgtccttcttctgcactttcgtaacagcctttttggagcccttcttgggagcaggagcggatttcgctggatccggcatttttgcgcgaaaaaagagaaaagagacttaaagaagtaatccgaactacc

SEQ ID NO: 1087 - DNA, 29684 bp, Homo sapiens
tcttcaatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccatggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctctacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaaccacaaggtcttcctctgcgttctctcctttctggatgccagatgtgtgtgtgtcgatttatctgggtgcaggtctcagcactatgtacctaccaggtgaaactaaatcagtatactcaaaacatcacagcagggtccttaaactgtgtaccaacagtacctcagctaggccagctctaagtaggatgtctagagtaagacttaggccctaagattgtatcattattccaaatgtatgcctgtacatagtaaataataataattcaaacaaatgagcaataatgaacaatgaaatatcttcctcccacccaaaacctagatctgcagtcaccttccacagaaacaaaactgctaatatatatatacatattatgcatatatatgtatatattagcattattatatataaactatatatatatatatatatacacacatatatatagttttaaagctgtgggtggtagaacactttctaagtattgtcctatatcttacttttatcacttaaaataccttaaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataaatggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttcgttaaaaatgataatgcaaaagtcaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttcgttttttttttttttttttttttttttgagacagagtctcactccgttgcccaggctggaatgcagtggtgtgatcttggctcactgcaacctctgacagagctgtttcaacaagatactttgggtaattcaagcagaagtgtttcatggttcaagtgacaacaaaaggactagggctgggaagagtccattttctttacctctacacagactctaggacactcagcatcagtgacttactgagaatcatatcttttttatattacattttaatgtgaattttcattgaaatataacttatgtacaacaagccataaatgtatgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaactgtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgtttgacagtatctgatggaggtatgttacaatttcccactcttttggatatacaaatgcaaattaagcatttccctaatgactatgatattgaccatttttcacgtttattacctatttgggtatccttttttgtaaggtctttttgataatttttctattgtctgtctttttcttactgacttacaggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgccgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaaactcataaatttccattatacattattttattcatgaattacttagatgttttttggagggtagttttttgctattgatttctaatattatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcaaatattttctaccattactagtgtttgacagtttctgatggagatgtgacagcacttcccactcttttggatatataaagcaaagatggcagtgtttgggcagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggagggggaaaaggcactattgtctcttttccgccttagtctcctaagaaccccatttttacttagccaaaccaactgcctctggagaaaagaaaagtagttgaagcatttttggttatgtgtagaggtgtatgtcgaaaggaaaagcccattgacttggagcttgttttgctagtgatatcattgatcttacatatgtgagtattcatatcaatgtagtaggatgtttatatctggatgtttgcccttctgtgtgtttgtcttaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctttttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcatggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttggcagagctctgaggctggatgttgcaaggagaaaaaataggaagcccacagggccaagcttgggcctccttgtacctcctccactgtatacatacattttgggttcatatttttcaggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaacccccatcaacaatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaagaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcaggagaatagcatgaacccgggaagcggagcttgcagtgagctgagatagcgccactgcactccagcctgggcaacagagcgagactacgtctcaaataataataataataataataataatgatgataataaagtcactgaaatggcaagtgtgtgagtcagggttcactcctagttgaccactgccaaaagggcatggttactgaccagatgacacggtcattcagggaaggatggaccttgtagagcaggggttcccaacccttactggtccgtggcctgttaggaactgggctgcacagcaggaggtgagcttcttcatgagccagcattacggcctgagctcctcctcctgtccaatcagtggcaacattagattctcacagaaacatgaaccctattgtgaattgtgcgtgcctgatgatctgaggtggaacagttaccttccaaaactgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaagggttaatgccttatggatgcattttctagggccaggtttcccaagggggtaaagggcatgtcttttgtgaaaaggacctggatgctaaacaggcaaccttgtcccccatcaactttctccttagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttctttttttctccttcattttattttcccctccctcccactcttccctccactccatgacccccccttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctctagaacaaagtctccttgggggggaaaaaagttcatcttcaacccaaattcatttcaagtattaaatggcacagagatatcagttgtctctggaactagggagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagctagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgcccacttgctccccgtgagcactgcgtacaaacatccaaaagttcaacaacaccagaactgtgtgtctcatggtatgtaactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagccaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctgtttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacatagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccgcggcgggcccctggcgccacactgtggccgcatgtgcatattgcagcctccgcctgtatctgggggccgcagccgccagcgcccggggacccagctgcggcgaaagctgttgggcgcgcgcttctccgcagctccgcgcccccgccaaaacccagtgagaaattatttgcattcctggaggctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgccagctcccgggccccggcgcggcgccacctggcggccgtctgtggaggttgcagctgccgccaagccccggggatgctgccggcctcaggtgcgcccggccgagcctccgcggagaggaggattggtagatcacaggaaacgggaggacggcgctgggctcccagcaggcgccccattttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgaggccctggagggatctgatgcagctggcggggagaaaggtgggtcggacttagaggggtggtggggtggaggaatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttaggggtcgttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaagagttgggtccattctggatctttcctagctaaatgccttcaggatttaggaatattttcctaggagggccaaggattagctagacctgcccagcgattccagccctgagaaccagacagaatggaggtatagctgacagctggctgggagggggctgacggtcctcactgccaccaggcttagttggagacagattcctcgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgagacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggactgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaataaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccatgcgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacaaataaaattgcttgctgtccttctctctttattctccacttcttgttttttctaaatgtggggtcaaaacttccatgagggtaagaagttcagttttctgcctttccccttcatctccctatcacacatgtatactactcaacacttagagaagattaaaaaaagaataaattgtggagagggagcatatgtgaaagtaaaagattcccagacataatatgggagttaatggagaaagaaaatctctaaggaagactagaaataattgggttagggattctcgagaagtaaattaaattccccaaatgtggtattctctgagaagataattttgaagaagcaatggcgtgatatccagtgaaacagcagtcctctggagcctggctgtgacttcaaggcccagttcttctggaagggcagaaaaatacttcgaagaggagaaatgagcatttatataggtttataagtaccatctttattttagaaaataatcattttctaccttgaattctagtttattgtgaccaaagattgtaaaatttcaggatatggctgaattaaaatcttggtcctgcacttaagtagctccttgaattgcaatttcttatcccaattattttatcctttcattccactgtgaaatctatatcatggcacttaatagtcaactttattattttaacaaatgcttatttacctttcatgggttatttcatttagccttcataatatctgttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcagtggcactatctcagctaactgcaacctccatctcccaggttcaagtgattctcctgcctcagcctcccaagtagctggaattataggcacacgccaccacacccggctaatttttgtatttttagtagagacgaggtttcaccatcttggctaggctggtctcaaactcttgacttcaaataattcacccacctcgccctcccaaagtgctgggattacaggcatgagctgccgcacctggccttggtgctatttttaaggatatgtatatctgattttttttctgtttctcttattctttaattctgttaattctttattcaggtattttacttttcttagctcaactttggtaatttgtatggaaaagtcaacattttgtctacattcgcaaatatatatcaaaaatacacatcattttaatatcttctatatctagtattacttatgtgctttttcaatagtaagtttacggaaggattaactcttaattttcttttcagggaacacggtgtttggttttataaattccattttggtggaataggaaggtatgatctgtttcattgactatgctttcatcttactttatgccttctactttccacaggtttttgttgtgttcctttgttagcgtttgagttaaaaacttaattctctctctgttgctcaggctggagtgcagtggcatgatctcaactcactgtaaccctccgcctcccaggctcaacgatcctcctgcctcggcctccctagcagttcgaactataggcgtgcaccacgacatccagctaatttttgtatctgttggagacacagggtcctgccatgttgtccaggctggtctccaattccagaggcaataattgggaggccaaggcgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagtgtataatttttattctgatatcccctttaacccatgtgctttttcctaagagtacaacttaaggagggcatgtttgattattttattgttttataatcagttaactatgccctggtcctatatggtttcagcttttcagcacttgttgagacttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcagtaagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgactttaaaaaaaaaaaaaaaagaggaacttgctctgtcaccaggccagagtgcaaaggtgcaatcatagctcactgcagccttgacctcctaggctcaagcaatcctcctgcttcagcctcctaagtagctgggactacaggtgcatgtaaccatgcctggctaatatttttactttttgtagagacaggggtcttgctttgttgcccaggctgatcttgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatgtgtttagaaatttctctttgttcccaaattttgtcactgtgaatctaggtgagggtccttctcatcatgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatttgtattttatttcttacatgttttcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggacggagaaactcaaactatgtgtttcctgtgctttcacactacaacaatcaacacagaagactgacggcggaggggggttctccatacagcaagcaagcaatcagttctgcagtggacaccagctgagtgtactccaattcaatttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggtaaagtatgggggaaggagcatggagcttccatgcacctccactgggtgcgccgcccttcaggaacctctacatgttcagctatccagaagctctccaagccctgtccttttgggtctttgtatggaggctccattgcataagaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagaccagcctgggcaaaatggtgaaaccccatctctataaaaaatacaaaaattagttggttgcggtggtacatgcctgtggtcccaactactagggaggctgaggtgggaggagagcttgagcccaggaggttggggctgcagtgagttgagatcgtgccactgcactccagcatgggtaatagagtgagacccggtctctagaaaataaataaaaagacttcagtcaccaaggtaaggagatgggtggatattcctactgtggtacctgaactgtcatcctgtcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagatgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcataggttatttcctcatgccaggaagaacagtcacagttctgtttcattacgcttctatctttgagactcaaattcccccctccccactataaattatttgcacatactagtctagaaaaatttaatatgccactttcccccacaaacacatctccacaatcataaacaccatgaaataaacttctcttagacaaatgaaaaagtttcttacctttttctccaggctaaggatcaaaattcaagttttacttggttaactctcctgctaatctgaaaactgtcttctactctatagatgcttgctgtttcaggggggcaggcgggagttatttaagaataatttccattacctaataccttgatactaatgtgaaaaaaattatgaaaatcagaggtcaaacacttaaaaagatccatgaaaaatctcctacaaagacacttaaataagtaaaatcatcaaattttcataatgtgacagggagaagattgaagaaaccaaaaaaagcaagtatgttcctttgctggaactaatcctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagagttctccagagggacaaaactaataggggagacatatatctatagatatagatagatgataatagattagatacagatatattaaaaggagtttatgaaggagaattggctcacatgattacaaggcaaagtcctacagtgggccgtctgcaagctgaggaagaaagaagccagtagtggttcagtctgagtccaaaagcctcaagagtagggaagcccacagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccaccttctctctcctgctttgttgtagctaccctggcagccgactggatggtgccaacccacattgagggtgagtcttcctctcctagtccactgactcaaatgttaatctcctctggtaacaccctcacagacacacccagaaacaatacttagctatctaggcatcctttaatcctatcaagttgacacctaatattaaccatcacaccctaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggtaatttgcagttattgtcctttgatcatgtaaagcaactgagatcatttgctcctgacctcacgtcactaatctatatccttcattttttgctccaagtgttccttcttctgagtgcctagtgctgctccagtacctagatatctctctctccccctctctttctgtctcaatatccaatcaatcccaagctgtattagctctttaccaactttgggaaagtggaccagtatccaggcttggataaaccaaggaaaaatactaaggaactgcttaaagctctagtggttcttctactttgctgtttctggctttggccatctaaagcaaagttccttggattggttgacagtgagatagtctctagattcttgtgtctctttttagtaggaccacctaagatgtatcatccattgtataatgagttcttgaccaaagaaaagaaatcttaaggtcttcggactctgtcatctttcttgtttgccactctttggactgtaatttgaagagaaaaaaccttgttttcttgtgaaaattttggatgctgagtagttgacaacaacagtaacttcagctagaaaatgctggaaacaatttaataagcagaaatgattaaatccaaaatcatcaacatgactccaccaaccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtctcatttcctaatttattattttcctaatgggccacatagcagacactgaaggttctacataacaaaggtcctacaagtaaattgtgaaaatcccttattggatggtgtttttagaatacagaaggtcttatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacaacactgatcaaatatttaccatgttccagccactgtactaagtgctttgggtacattacctcatttaatcttcatatcaagcctagaaggtagtttccattatgttttccactttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagccttcagcatgatatgtgatcatgtgagagccacgttatgtgtattctttttaccacctcttctgtatccatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtcttatagtgttccataaagtgatgggactataattgtccatcttcaagtatccttctatgactcatgtataatcccttgacttttaggagattcctggcagttaatgtcaatactgcccttcataatgcttctgagttagcttaggtaaggtccttaaatacccaatgacttatactctgaggcttctaaactggtatgtggacctcggtggttgcaacttcacccaaatcctcattctgtgttgtgctgtccctaatttagagggcaaaagatttcaaactcaatcatttcttgttaaattcaactcttggagctccacctgtcataaacacaatcccatttcccatgtactcagttacttctgtttcttgaatccatcattcatcccatagatattgagtgcctaatgtattccagatatagttctacataatagggatagagcggtgtatgaaacaaagcacctaccttcataggacttattctgaggaggtaggaggggagacaaatgatataataacttggactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggcaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaatacattagtattcagatggtatatggagaataattaagaaagttatgagaggccgggcgcactggctcacacctataatcccagcactttgggaggccgaggtgggtggatcacaaggtcaggagatcgagaccatcctaacacagtgaaaccccgtctctactaaaaatacaaaaaattagctgggtatggtggcacttgcctgtagtcccagctactcgggaggctgaagcaggagaatcgcttgaacccaggaggtggaggttgcagtgagccgagattgcaccactgcactccagcctggacaacagagcgagacgcgagactccgtctcaaaaaaaaaaaaagttatgagataaggaataccaagaagtgaggaaagaaaaggaggggagcttgttatcttacctaagatgttcagggaagacctcaatgacagttggtaaagtaacttctgagcaaaagcttacaagaaattaggaagccagtcatgcaagtatctagggatgagcctttgagaaaaggaaatagcaagtgcaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggaaggagagagcagaatcaaggaggccatttaaaatgccattgcaaatatccaagagaggtggaagcttggagcagggaaacagtggtggaggtggtgagatgtggttggatgctggacatattttgagccaagaggattgtctgataaattgcgtttggaaaataagaaaaagcttattcactcaccagcctaatagtcacaccaatctataatcccagcactttgggaagccaaggcaggtggatcacttgaatccaggagttcaagaccaacctgagcaacatagtgagaccccatctctacaaaaacaaaaactctaaaaattagccaagcatgtggcatgcacctgtagtcccagctactcaggaagctgaggtgggatgatcacttgagcctgggaggtcaaggctgcaatgaactgtaatcatgccactgcactccagactgggtgacagagcaagaccctgtctgggaaaagaaaaaggcatggcggggggggggggggcgggcatggtggtacacacctgtaatcccagcactttgggaggctgaggcaggcagatcacctgaggttgggagttcgagaccagcctggccaacatggtgaaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagattccatctcgaaagaaagaagaaagaaagagagagagagagagaaagagagaaaagaaagaataatcacaccccaagaaaatcaagctaggaccatggtgagcaatgctccaagagtgttctgatgctgtaaactgagtatgatgtgcataaattgttttgcactctgcaggtaggagggtgggatagccaaagctgttcaatataataatattaaaaaataaaatctcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagttgaaagaggttacagtaaaaactgggtaaaactaaaacttaaaaaataatttcagaggatacatgatatactcgtcacacagaaaactccagttgaaccttatggacttgaggaatggatacctttgtgtctccatcacttagcacagtagctggcaccatgtaagttctcacagaattttcctgaactctccaaccagaggcaacctttcactctccattcacataacatttccttctttctcttcttttgggaataacatatcttgcttgaattatatttatctttatgccagtttaattctctcttttagattcatttacatctttgtatcctctagctcattattttttcaaaataaaatggattaacataaaaaattattaaagagataaactaaaggaaaatattacaacctggctgaggggcaaaaattttatgttcaacatatatttgataatacatactgagaaaacacggtctacttttacttttcaaaagtttgttcatgttgacattgtggggcctagaagatttttatcaagttttctatttttgccaagtcatatgatctgctatagttcagctatagttaatcaaatgtagaaaagaaaaaaattttccataatatctagtaattctccaaaacaagcttgttcctagttaaacactgacattctttggtaactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttaaaaagctacacaattattcgttatgcaaggaatgaggccttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaaaatgctttacatgacagtagaacatttaggctaagctggaggactggggagaacaagtgaagaaggtaagttttggctagataataggtggcctttagtgtcaggatgaggatttggaagttaatcttttggtcagtggataataaatgatggcatttgtgtagttgagccagttgacaatgctttaacaacttcaaaaggccctgaaaaacatggtccctaatccttaagaaaaaaggaactcctgacttcaggaccctaagctaggaggaaattggataaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaaaaaaatcatgtataccgcattttatatcttttaattgggtgtaaatttgaatttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcaggacatctgtgacacaaagactgtgacacacccacaggtcgattaacatgaggacccaacacctattaaaacatccacactcctgagaacactaaaaaccaaccacctcgtcaggtcccacctccagtctagctgaatcaggaaacctcaggagaagcacctggaagcaggtttaacaagcgcaaaggtgactcttataattgggaaagtttggaaccaagacagggttcttgtcctggaggaagtattttcctgtggagaaggacctgtaaacagcctatgaagtgctcagctttcaccaagaaaagaaaaacatgggctgatagggttaaggaaacgtttgactgaagaggattaaatcctgaaggttagggatgtctttgggcgctggggtctctcaatcaccaaagatcgacattacaggccaggtagctctttgtccccccagaggactgtcctgtgccttatgcttagcactcctggcctctgcccattggatacttctagcacctcccccgcaacacacacacacctgacaacccaaaacatctacagatattgccaaatactccacagggggtggggtggtggcaatatatctccctgtttgaagtcactggaatggaagttaggggaggatggctaagtcaggacttgcaaaaaggctaagggacgaaagcacatggctatattagacaaagtttgtgacagacgcctgtaggtatatggtaaggaaaacagattaaaacactaagaaatagtaagaggtcggaccgagggtttctcatctgtatgggaaatctcatctcgttcattactttcagaaacaaaaaggaaaacgactttaaagatacaggttaaaggccgaaggggtgtagaaccaccccccgcctccttccctccatccctcccaaatatcccagaacgagtcaaacctttcgaatctcgtagcacagataacaagcaactcagtaagactggacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggatgtgatggtggagcgcttgttgtagtgcgccaggcgggacgcctctcccgcgatgcgctcgaagatgtcgttgacgaaggagttcatgatgcccatggccttggacgagatgccggtgtcggggtggacctgcttcagcaccttgtacacgtaaacggagtagctctccttgcggctgcgcttgcgcttcttgccgtccttcttctgcactttcgtaacagcctttttggagcccttcttgggagcaggagcggatttcgctggatccggcatttttgcgcgaaaaaagagaaaagagacttaaagaagtaatccgaactacc

SEQ ID NO: 1088 - DNA, 12429 bp, Homo sapiens
tgggtggctctgaaaagagccttttggatacgatggaacctccggccgaaccgccacttcttaagcccgctctccacggatgcggcgggccagctggatgtccttgggcataatggtcacgcgcttggcgtggatggcgcacaggttcgtgtcttcgaacagccccaccaggtaggcctcgctggcctcctgcagcgccatcacggccgagctctggaagcgcaggtccgtcttaaagtcctgcgcgatctcgcgtaccagccgctggaagggcagcttgcggatcagcagctccgtggacttctggtagcgccggatctcccgcagggctacggtgccgggccggtagcggtgcggcttcttcaccccgcccgtggccggcgcgctcttgcgggccgccttggtggccagctgcttcctcggggccttgccgccggtcgacttgcgagcagtctgcttagtacgggccatagcgaaccaaaacacaggcttaccagcgcagcggcggggagaaaaacgagctcctagccccgccgcagccgtctttataagcacagtcttttcccgattgggcggaacaataattgaaaatcccgcgctggctgtccattggctgtgacgtcacccgtcctaaagtcaccggttggcttgggcagattcctccctaatcccgcccaccccgcctcactttctacttaccagttggcgaagtttcgcaagcttgtttttcccctttccttcagggtgaaagtcattttccattgcagctttgtcagattgttccctttccgcccttcgcttccttagaacacactgcccgcaataccccccctttcttgctgcgccctacagctcccgcgtggaacctcattcttccatttgccccccgcccccagttgctacttggcggatcgtttttcgcctgtcgggtgccttttgggtgggagaggtgcccgcccccaggacgcaagattccgcctccgaggcccttactctccgccgccagggcgctttggaaaacaaaacagaaactaagacttaagtcagctcagtgaagccaagacccagctccgccacactagcgagcactacccgctcagggccctccccatcgggggtggggacgaggagcacgtcccgctggtgccagactaggtctaagtgtccggccatagcctgcggaaaccactagggaagcgcgcgctccgcgcgcaacacttcagcgcgttgggtactgcccgcggcgctggtgtttgtgactgtgtggagcggaccgtggcggcgcccaggacgtttggtgcctgcacctgccctgggaagtcctaggactggggacccactcatcgaagagccaaggcagttacgtgctccagatggaagacggcgcgcacacacacacaccccgccccgccccgccccgtcccgtcccgtcccgtcccgtcccgtcagctccaggttcgctattcactactgaggaacgctggactgagagtggccagcattaacaactcttttatttgaaaacgtgggtggctctgaaaagagccttttgagttcacaggtgccccttcgagacgcgggccgggctgggcccacttgggccggacgtcagcctcacttgccctttgccttgtggtgactctccgtcttcttagggagcagtacggcctggatgttaggcaagacgccgccctgggcgatggtgactttgcccagcagcttgttcagttcctcgtcgttgcggatggccagctggaggtgacgagggatgatgcgcgtcttcttgttgtcccgagccgcgttgcccgccagctccaggatctcggcggtcagatactcgaggaccgcagccatgtagacgggcgcgccggcccccactcgctccgcgtagttgcctttgcgcagcaagcgatgcactcgccctaccgggaactgaaggccagcgcgggacgagcgcgacttggccttggcgcgggccttgcctccttgcttgccacgaccagacatgacagcgatagtagtcaccgagagaaactcctgcctggcgatcgggaaagtcgccgaaaacgccgctgcttcacctttttatagacagaacggcgattgtccacggagcactttgattggctcaagcaaattttgtcccgatagccaataggatagctcagccagaatccactcatttacataatctcgtctccctcgcattgcgcgccgcggaaaactcgcgaaccataacgcagcgtcatgcgcacagcctctgtaagtacacagtcgtttccggtagaccccgagcctaccgctctgcttgcgttctcgggggtcggtgtcggtcttgggtctggccatgcctgagcctgcaaagttcgcgccggctcccaagaagggctccaagaaagccgtcaccaaagcccagaagaaagacggcaagaagcgcaagcgcagccgcaaggagagctactccatctacgtgtacaaggtgctgaagcgggtccaccccgacaccggcatctggtgcaaggccatgggcatcatgaactccttcctcaacgacatcttcgagcgcatcgcgggagaggcgtcccgcctggcgcactacaacaagcgctccaccatcacgtcccggagatccagacggccgtgcgcctgctgctgcccggcgagctggccaagcacgccgtgtccgagggcaccaaggcggtcaccaagtacgccagctccaagtgagtccctgccgggacctggcgctcgctcgctccctccctccctccctccgcgggtcgccggctgctttgtctccaaaggctcttttcagggccacttaaccccgttagtgaaataagctgttttcccactgcttactgtgagttctacttaggggttttccctcagcacctatcccttttcctgcagatgatgggagaggaatataagataaagctataagatgtagcttggtcgagaactaccttgtagtgacagggtcatgtgcacataatttgccttttccaaagtgagacgatatgctacgggtgcggtcaatgtaaatctgctcaggagagtcgagggaaaaagtgttaactgcatattgagctcgcaaaattgtgtagtaacctgaaaatattcctaatagttttgcgaccaagcctcaccatataaactttccttccgcacctgtagacctccattctgtggttgaagcaatttttggtttatatagctctcttgtctcaatttggtattcctttcaggtactgtgagtctataggtatttatttctgggtttcaagacgttaaatgccatcagaattgagtaatgcaaaggctgctgtcatggatagtaaagctttttagtcaagtgctgatagacaattccccattgttatcgttgggtattttacaattttctgggcaagaaatgtaatgaaaaattaagtaagttttaaaggccttcgtctttgagactggatacctaaaacaatagtgtttcctaaacagttaaaacttatttaaccctgaagctttcgagacacacaaatatatacaaatatatattgtatatttcttaaaccccacatagttccactgatctaaatcactgggggcgagaggcaaggatagacaatctatgacacaacaccaggtgattcataagtttggtaaccactgacatttgattatgcagttgccatattccttagtaagaacctggtcacaattttcactcactaccccaggcaattccccctccccacaccccccttttttctgagaatttcagtgagatatacaaaagtttcatttaatcctttattaattccagactttatatatttttattaggatttaaaatacatttcaaaaagatcaagtgagaacagaagataaaagtaccaagataaaggcataatacaaacttagaaaatacatgttaagcatactgcggcgtcctggtagccccttgcttttgttcacttttttctcttatgtacctacataaaatcccaaatagtatcttccaggatgacacacttgctgtctgccccacccaattaaaaacagattttttagttattaggtattgtgctgaatctaccttattttattgccaaaagaaaaaaaaaaaaaagcttttcaaagcttcatccccaggaaacattttcctgcttttacacataccttatatggctctactgagagataaggcctaagcctgaaaagttaatttaaagcatggaggtaggggtgagacagaaagacaacagggaaaagttgagtttataaggtaagtatatatcttccttttaacagccacctgcatggcgttcggtaaataacctaattatatgtgggggaaggtagtggtcaacatttggtcctggggactgagaataagagcaggaaagcaataaacagctaactatgagagtgacttaatgtaattatattacctgtcaatcgctacttttcctttcttaccaaaattcacacaggtatgaaagcaatatgacattcaggctccattatgtgtatttgtgcacatcacttcccacgataagggagaagaaaagaaaccactgcacattcggataaaacatgctgggaatacagcagtaaacagaatagaaaaagtctacattttaattagcagataagtaaaaataagtgactaaatgtatattattcagggggccatatgtgcaattgctgttaagtaaagcagaacatggagtggagtagggatgacaggtttcatcagttaatacttgagcagagagctgaatacagtaagatagttgtaggatatcttgaggcagagtattctcagaacagaacatggtaagtacaaaggccccaaggcaggaacaagcttggtgaatgtgagaaatatgcaagctggttaatgtggctgaagcacagtgaccaagggaaagttttacagagatcacggaggtgcttgagggctggattatgtaggccattaaggagcatcacaggccactgcagagattttgtcttttaaatgagatagagtgctcttggagaatgtgactggagaggccgatggtagcagtggagatgcagagtagtagccgagatattttaaatgaaattgatttagtataggctgactgaaagagaaatcaaggattaattgtaggtttttacactgagcacttgaaaagagctgctatttgctgatatgagtaaggagtagtcttggaggaagaaaaccaagagtactgttttgaacaaaatgttgaagactcctggtaaatatcgaagtgtaaatatcaaataggaagtcagaaatatgagaatctggagtttaggaaagagaagggggttaggtttgtaagatctcatatcagtctgattcttatttttttgtagataatctaccctttctttctgtaaatgtttagaagcatgatgtctatgtgtgtatatatacacacacactcactcccccccgccaggactgcctcagttttcatctcagtatttgactaaaaccttctattcaacttcagtttcagccttagaataaccagatgtctaagtcaatgtcatttggggcatctctagacttgtgcaatcacaaaagtcaccattaccgctacatagtacgtattatgaccaatggatatcattcagagttctagtttacatatgctattatcaaacatatgtaagccttttaatgtaacttgggagtgaaattagtaaaattctatcaatttacataaattaattttactgtaaaaataaaatacattatgaaagtttctgtactaatgtctttgattacaatttttaaagtatttcccatttttttattttgaaaattttaaacctacagaaaagttggaaaaaaaagtacaaagaccagccatagtcccttcacctggattcaccaattattacaattttgctgcatttgccttatctttgtcttctcatgtacacagacagcctctgaaccatttgaaaataaactgcaaatatgttggcacttctccctaaatatggtggcatgtctcttaaaaataggatattctcctaaatagctacaatcacattattacacctaacaaatttaatgctgattcagtaatattaatatgcaatccatattcaaatttctccaattattgaaaaaattctatatagatgttgtattagtttcttgtggctgctgcaacaaattactacaaactcaatggttttaaaacaacagtcattctcttacagttttggaggtctgaagtacaaaatcaattttactcggtagaaatcaaggctgcactccctccagagaccttaagggagggtctatttccatgccttttccagcttctagaggtttatttctggtttatggtcccttccctctgtcttcaaagcaagcagcctattaatcttcaaatccctctctccttctatcgcctccttctacacttgactttcttgcctctcctataaggactgtggtgattacatttggggcctacctggataatctggcataatctctcaatctcagaatcacatctgcaaaatcctcttggctatataaggtaatattcacaggctgtagggattaggatatggacatatttgggagccacatttagcctgccacagccattgactactgttatgggttgagttgtgtccccccgaaagatatgttgaagtctaacccctagttgcttagaattttgccttctttggaaacagggtctttacagaggtaatcaagttaaaatgaggtctttagggtgggccctaatccagtatgactgatacccttataagaagacatggagacagccgggtgcagtggctcacatctgtaatcccagcactttgggaggccaaggcaggtggatcacctgaggtcagttcgaggccagcctgactaacatgatgaaactccatctctaccaaaaatacaaaatcagccgggcgtgctgacgcatgcctgtaatcccagctactcgggaggctgaggcaggaaaattgcttgaacccggggcacagaggttgcagtaagccaagatcatgccactgcactccagcctgggcaacaagagtgaaactccatctcaagaaagaaagtaaaaaaacatggagacatacatgaaaaaactgaggtagagattacagttatgctgccagaaaccaaagaacaagtggggctaccagacactgaaagacaggagtcttcccctagtgggtttggagagagcatggccctaccaacacgttgatttcaaacttctagcctctaaaaccatgaaagaataactttgtgttgttttacgccatacagtttgtggtactttgacagccccaggaaattagtacaactactaaaattttttgatttagtttatttaaaatttttaaataaaatttcacatctgaaaaaaaaccctggacatttttcctgtgatggtaatattagtctttagccttagtcaagtattaacatttggacatctgttccaaatatgtaattggagcaactctgtcctaattgaccctatttgacttgagacctttcatgaaaggtctttccttttatctaggaaattattattcctgaaatatttcaagattcaaactggtataagtaaatatgtcagacaaattggcttaactggaagtccaaaggtgcagcagggatccaaggttggctgaactccatgagtggctcagttccctgattctcccacactgtgtcctcctctgcatattgtctataatcattcttgccttcatacctaaagacagtccatcctcctgctgcctcttgaaagcaaataagctgctttcccaaaagataatagcatactacactcccctgctgagttagttgttactcagttcacttcctgaaatgttaaatgccaatgagtttgatctagattcctgaactaatcacagtaagaagcaggttcagacagcaattaaactaatcaggccaaccctaagaactgtgggtaaaatgcgtttctgggaaacacatgtggcagcactataacagaaacaattagaaaaataaatgctacctagtcaataacatacattataggactatgaactactaagttacacctcatgacaaacacatgagtaataaagtctagaaaaatacttaaaggtgatgtccatcattctcattgctgtgttcacagttcacaggtagaccctaaagacaggcttgtgttgtctttactgaaccctagatgcatctctcaaactgtcaactgcacatatccacttgaatagcaaagagcttctcaaatttcagtcggaactctggatctcccttcagtgtcccaacgaatatcttctctcagtgttctatcctaatagtaccactatgtacacagttgctcaagccaaaaatctaggggtttcactgttagctaaatcctgttcctcagccacacctattaattctacctcaaagataaaatccaacatttgtttccattaccaccattgcactccagcatgtcatttatccgttgtttttcacactttagcatatatcaccatcacccagaaagcttaacacaaataatggaacctgggaattttcatttttagtaacttcaagtaatgctgatgctgctggtctggagagactttaagtcttaatcactgttccagcccacaacactgcaacagcctcctaattgctttcctcgcttctattgtggccagcctaggatttacgatccccagagcaatcagtataatattttgaggttaatgaggctgtgtgattccaagtccagtgttcccaaagcagaaaacaaacctaatcaacctcccttgcaaattggtggtccttctcctcttcagggatcccaaactctggcttcagaaatcgtatattttgttgctattgtatggaacaaacccttaaactggacaagcttttccgagtgataactcttggggaaaaaaaccatttaatggtattgggtagattttagggtatctcaactagaaagcgcagaaggttatcggtgttaactcctggttatcaaaatcgaacttccatctacctccttaaggaattttcacatgagtggtggtgtaggcacgtgtttgtgaaccaatgatataaaaacctcaggtttctcgataccatatataaaagttgagctattcccttttaagtacacatctgagagcatacaatgcatttaatctctaccttcattttaccactgaagagcggacccaacctttgttcatatacacaatttgatcttacataaacttatcaaaattaacactgcgtttctcaacaggaaacaatctcctgggcacatattcacgggtacgtaaccaggccaaagacagttcaagagcagccctctaaggcaagccccaacctatctatgccatagtaagataccactatcaatctatgtaagcttacttatagcaatgcctatgtgaaaagaaaatagttatctgtgcttggtgttgtgtgctctcctaaagttaaccagacgtgaagccaaaaacatcaactgggactgacaacacaagaaagattctttaactgaggtggttaaatggccctgaaaagagcctttggagacaaagcagccggcgacccgcggagggagggagggagggagcgagcgagcgccaggtcccggcagggactcacttggagctggcgtacttggtgaccgccttggtgccctcggacacggcgtgcttggccagctcgccgggcagcagcaggcgcacggccgtctggatctccgggacgtgatggtggagcgcttgttgtagtgcgccaggcgggacgcctctcccgcgatgcgctcgaagatgtcgttgaggaaggagttcatgatgcccatggccttgcaccagatgccggtgtcggggtggacccgcttcagcaccttgtacacgtagatggagtagctctccttgcggctgcgcttgcgcttcttgccgtctttcttctgggctttggtgacggctttcttggagcccttcttgggagccggcgcgaactttgcaggctcaggcatggccagacccaagaccgacaccgacccccgagaacgcaagcagagcggtaggctcggggtctaccggaaacgactgtgtacttacagaggctgtgcgcatgacgctgcgttatggttcgcgagttttccgcggcgcgcaatgcgagggagacgagattatgtaaatgagtggattctggctgagctatcctattggctatcgggacaaaatttgcttgagccaatcaaagtgctccgtggacaatcgccgttctgtctataaaaaggtgaagcagcggcgttttcggcgactttcccgatcgccaggcaggagtttctctcggtgactactatcgctgtcatgtctggtcgtggcaagcaaggaggcaaggcccgcgccaaggccaagtcgcgctcgtcccgcgctggccttcagttcccggtagggcgagtgcatcgcttgctgcgcaaaggcaactacgcggagcgagtgggggccggcgcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgtcttgcctaacatccaggccgtactgctccctaagaagacggagagtcaccacaaggcaaagggcaagtgaggctgacgtccggcccaagtgggcccagcccggcccgcgtctcgaaggggcacctgtgaactcaaaaggctcttttcagagccacccacgttttcaaataaaagagttgttaatgctggccactctcagtccagcgttcctcagtagtgaatagcgaacctggagctgacgggacgggacgggacgggacgggacggggcggggcggggcggggtgtgtgtgtgtgcgcgccgtcttccatctggagcacgtaactgccttggctcttcgatgagtgggtccccagtcctaggacttcccagggcaggtgcaggcaccaaacgtcctgggcgccgccacggtccgctccacacagtcacaaacaccagcgccgcgggcagtacccaacgcgctgaagtgttgcgcgcggagcgcgcgcttccctagtggtttccgcaggctatggccggacacttagacctagtctggcaccagcgggacgtgctcctcgtccccacccccgatggggagggccctgagcgggtagtgctcgctagtgtggcggagctgggtcttggcttcactgagctgacttaagtcttagtttctgttttgttttccaaagcgccctggcggcggagagtaagggcctcggaggcggaatcttgcgtcctgggggcgggcacctctcccacccaaaaggcacccgacaggcgaaaaacgatccgccaagtagcaactgggggcggggggcaaatggaagaatgaggttccacgcgggagctgtagggcgcagcaagaaagggggggtattgcgggcagtgtgttctaaggaagcgaagggcggaaagggaacaatctgacaaagctgcaatggaaaatgactttcaccctgaaggaaaggggaaaaacaagcttgcgaaacttcgccaactggtaagtagaaagtgaggcggggtgggcgggattagggaggaatctgcccaagccaaccggtgactttaggacgggtgacgtcacagccaatggacagccagcgcgggattttcaattattgttccgcccaatcgggaaaagactgtgcttataaagacggctgcggcggggctaggagctcgtttttctccccgccgctgcgctggtaagcctgtgttttggttcgctatggcccgtactaagcagactgctcgcaagtcgaccggcggcaaggccccgaggaagcagctggccaccaaggcggcccgcaagagcgcgccggccacgggcggggtgaagaagccgcaccgctaccggcccggcaccgtagccctgcgggagatccggcgctaccagaagtccacggagctgctgatccgcaagctgcccttccagcggctggtacgcgagatcgcgcaggactttaagacggacctgcgcttccagagctcggccgtgatggcgctgcaggaggccagcgaggcctacctggtggggctgttcgaagacacgaacctgtgcgccatccacgccaagcgcgtgaccattatgcccaaggacatccagctggcccgccgcatccgtggagagcgggcttaagaagtggcggttcggccggaggttccatcgtatccaaaaggctcttttcagagccaccca

SEQ ID NO: 1089 - DNA, 12429 bp, Homo sapiens; identical to SEQ ID NO: 1088

SEQ ID NO: 1090 - DNA, 457 bp, Homo sapiens
agtggctctgaaaagagcctttagatcgaccacttaaaaatatgccttaggcccgctccccgcggatgcggcgggccaactggatgtccttgggcatgatggtcacgcgcttggcatggatggcgcacaggttcgtgtcttcgaacagccccaccaggtaggcctcgctggcctcctgcagcgccatcacggccgagctctggaagcgcaggtccgtcttaaagtcctgcgcgatctcgcgtaccagccgctggaagggcagcttgcggatcagcagctccgtagacttctggtagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccat

SEQ ID NO: 1091 - DNA, 28505 bp, Homo sapiens
agaagctgtctatcgggctccagcggtcatgtccggcagaggaaagggcggaaaaggcttaggcaaagggggcgctaagcgccaccgcaaggtcttgagagacaacattcagggcatcaccaagcctgccattcggcgtctagctcggcgtggcggcgttaagcggatctctggcctcatttacgaggagacccgcggtgtgctgaaggtgttcctggagaatgtgattcgggacgcagtcacctacaccgagcacgccaagcgcaagaccgtcacagccatggatgtggtgtacgcgctcaagcgccaggggcgcaccctgtacggcttcggaggctaggccgccgctccagctttgcacgtttcgatcccaaaggccctttttagggccgaccacttgctcatctgaggagttggacacttgactgcgtaaagtgcaacagtaacgatgttggaaggtaactttggcagtggggcgacaatcggatctgaagttaacggaaagctaccgcggcccatagcgctcacagccgtaaagacttaagtcgttgaccgaaagcggctttttcacttacctgggctttttttttttttttttttttttttttaaagcctttatcggtatgaaaggttgaatgctctaggtttgagcactgctttctcggcttgctcttctggtgcagtataggcacacctagagggccacgtcagtctttgcgatcaccaaatctggttctgagaaataggcactggcaatttacacatgccttgctgtgtaatctcactatatttgctcaggcaaagtgggagaagcagccttaggttttcattctagagatgccggctttcccacctgatcggcttagagttcacgattgactgttttgggcttcatttcaccctctacataacaagcgggtggactagatgccttagcaagggtccgtgttgtgtggtgtctccagccacgcactcagctcaatcttagcacagttaaaaaatgcctttctagcaagttatctgcccagtgcctgaaaagtatcatttcttgtgttcaataaaaagcctcctaatttaatcaaggacctatgagataactgtcttttagttgtggcattgcaaggatacaaatgcagagatattttaaagtgatccttctgtaagagtgaaccaacgatatgatctgaaagcaacttcacaggtaattcaggtatgtgacttctacctcttagggcctgttgtagcttagaatgagagacctgcagaaacatgcccaccatcaatacagaaagcacaatttaattttgacaaggccaaaagccaattctgtatcagcatggcgtatattacagcaagctattctttacgctaccacctctaaattgccctaatttggattaaaatgtgggttcacatttctaatccttatagttttgcagccattgcattgcccgtaagattttttttttcttcattccaggcttatgattttactgtgtatgtatttgggagaagaaattctgtcagctcccaaaggataaaccagcagttgctttattggtcttcagatgtggctgcaaacacttgagactgaactaagcttaaaacacggtacttagcaatcgggttgccagcaaagcactggatgcaagccttgccttccagaagcttaccagtcgggttgccagcaaagcagtggatgcaagacttgccctccaggagcttaccatcacaacgaagaagacaaataaatgcataatatatagacgacataaatccatactgtacacatttaagaataaacagtccagtagtaagaggcagtacatattcaatctgctgagaaatgtagacaataactactataagaatcctaatgctacagaagtcactggctgctgggaaaccggggaaaacttggctatggacgtgggggcttgtgtcggactctgaataaagagcagaatgattggcgtcctactgagatacatagtaaagggggcgagggcagggaggaagtggcaagaataacatttgtgaagatgtccaggtgagaaatagaggttttaatgctcaagatgtttccttttcccttttaaatctgacctgtgatttccagcattgctatttcgaatatcactgattgtttttaactttaaaggcaatgctgatgaatatatctgatccgcaccaagatccactaaagaaggagatcaaaaatttgaagataaagcagaaagggagtgggggagaaaacacgtccattgtctgaattagtggttctcaaagtgtagcctctcatctagcagcactgatcacctcggataaaatcttgggacccatgccagacctactgaatgagaaactgaggggtgagacatagtaatcggtgctttaaaaaagccctcccgatacacattaaaggttgaaagccactgatgcaggtaacagcttttctttttttcttttcttctttctttccctccctccctccctccctccctccctcccttccttccttcctttcttccttcccttccttcccttccttcctctttctttttttgagatggagtctcgatctgtcacacaggctggaatgcagtggcacgatcttggctcaccgcaatccccgcctcccgggttcaagtgattctcctgcctcagcctcccaggtagctgggactacaggtgcccaccaccatgccgggctaatttttgtatttttagtagagatggaggttttgccatgttggccaggctgatctcgaactcctggctttaggtgatccaccctcctcggcctcccaaaatgctgggattacaggcgtgagccaccgcgcctggcctctttttctttggcatgagccacggtgcccggccaattactgagaattcctgcctttttcacaggattattttaaggatcaaatgaaaagttctgtgtgaaagaagaatgaggccatgaagtgatacagaaaccaaaggtgatatatttattgcctttcccactcaatgtagttcgttttttgttttgttttgttttgtttttttgagagatggtttcactcgacttactgtgaccaggcgttgcttgggtactgctgctactatggaaataaacaaagacaaatccttaccctgagaaatgttgccagcctaatgctgaggttaaggaagggaaggggtattaagataggagagggcagaggcaaggaggagggcccaaagagatgagggcaaagaagagcaagggagccgggcactgtggttcatgcctataatcccagcactttcggaggccaaagcagacagatcatgaggtcaagagatcgagaccatcctggccaacatggtgaaaccccgtctctactaaaaatataaaacttagctgggcgtggtgacacacacctgtagtcccagctactccggaggctgaggcaggagaatcgcatgaacccgggagacggtggttggagtgagccgagatcgcgccactgcactccagcctgggtgacagagcaagactccatctcaaaaaaaaaaaaaaaaagaaaaaagaaaagaaaaaaaagaaagaaaaagaaaaaacaaaaaaccagaagagcaagggaaggctcacagggctgaatcttgaagaatgggggttctcagggttacagagaaggggaggacattctggacagaaatggaatgtgtgaagatattgtgtacttggagattgcagatgtcgtgtggggctaaacattcttgttcagctgcaagaacatctgaaacctgggaaggctgtgggaaacataaagaactagatgtataatattttcagtttttttttaaattagtaactattaatagagtagcacaaattaattgggtgcttgttctggaccagatactgtgctactactgtgctaggtcctttgtttttttagacatggggtctcactgctgttgccgaggctgaagtgcagtggcacagtcacagctcaccacagcctcgaacttctggcctcaagcaatcctcttgcctcagcctcctgagtcgctgggattacaggcatgagcaccgcaatttacagaaattgtcactttcatgatttccaacaaaacaacgagcaagttactcgttgttttacaaatgggaaaagttaaacctgttgagatttgcttcctgaagtcatgcacctgtttacatggacaaggctaggaatcaaacttgggtttgtctaactccagagtccttcctagtaattaacctccggtgctctgaactgccatgcaaaagaatgtgaacttcattctgaagggaatgggaaggtcgtggaaaatttttaagcatgaaagtgacaggctcaaaacagcaacaccaaccaaccaaccaaccaacaaaaaaccctcagtttttaaaagatagctcttggccgggcgcggtggctcacgcctgtaatcccaacgctttgggaggccgaggcgggcggatcacaaaatacaaaaaatacaaaactacaaaaaattagccggacgtggtggtgggcgcctatagtcccagctattccggaggctgaggcaggagaatcgcatgggcccggtaggccaaggttgcagtgagccgagctcgtgccactgcactccagcctgggcgacagagcgagactccgtctcataaaaaaaaaaaaaaaaaaaaagatagctgtcatacggagtggaagctcaatggcagggcagaaagaccagcctgactatgtaatctactagaccagagctggcgaggacttcagttaaggcatggtcatgggtggacggagaaaaggtgatacaattgaaagtcagaagacagatttagtaatatttggaactcatgagatttggacagaggacaagaggaagggacacccaaccagaacagatggggctaatgaaggtgtcttccaggaagatggggaatgtggaaagaaacaaatgggcttggaaagcaagatgaggcatgtggttttggaaataagctgggtttgaagtgcctagtatccatccagaaggacctgtctaccaggcagttagaaacattggtgtagccaggcacagtggctcacgtctataatcccagcactttgggaggccaaggtgggaggagggcttgagcccaggacttcaagaccagcctgggcgatgaagtgagaccctgactctacaaaaaataaaaaaaattagctgggcctggtggtgtgtgcccgtagtcccagctactcagatggctgaggtgggaggacccctgaacccaggagtccaaggttgcagtgagctttgattgtgctactgcactccagcctggacgagtgagaccctgtttctctttctctctctatctccctctctctctctctctctctctcacacacacacacacacacacacacacacacacacaaaatgtgtagagctcaggatagggtctcagcagaagatagcaatttgggagcgcttagctaagggacagaaatagtgaaagcaggcaatcaatctcacttgagttgcagggagaaaagaagatggccaaggccagcatgggggaaaccaggaatattgatggggaagagaaagacatgagaagactgagatggggacctagagaaggataagggtgaccaggagagtggacccaggggacaagtcctcttctaaggaagaaaaatcagtgtaaacgtggccatgtctcttaccacgtagtttccctctaaacacacacacacacacacacacacacacacacacacacacacacctgtcccccactagcctaaggcagaattaaatgtgaacaaagcacgtttttcacttcataaaagccacagattcagagtggacttactggcaaccaaggtagccacgtagaagctggttattagaggaagaggtgggttttcttcgagacagggtctcactccctgtcacccacactggagtgcagtggcacaatctcagctcacagcagcctccgcctcccggacttaagcgattctcccacctcagcctcccgagtagctgggaccacaggcaaatggcaccacccccggctaattttttcatttttctttctgtctttttttttttttttggtagagacacagggtctcgctatgtttcccaagctggtctggaactttgacttcaagcaatccgcccgacttggcctcccaaagtgctgggattaacagctgtgagccacaatgcctagtcagaggaagagtatttctttaccctatccttaattatcctttaactctcacctgagggtagacaatgatttaagtacagggaatgattaaatgttaaaacttaacattttagaatgttatcttgtattgatgaattcagcttatgctggtctcgcaaacaaatacgaagactgacagattcctgtgagtgcaggccttcacagtgccaggaccacaagatgtaatgaattctattcctgactggatataaaaaatgccacgaaattttccttttgagattcagccagggagacctcctggagtttagaggtacccagactggtgagtaaaaggagtgtgaccttgtgggggcagtcagaggacctagatgtctgacaccaacatccccaggttccagtctctgctcagttactactgggcctgagaagctgggtgcagagatagtgacccacccacctctgaaagtcactactttttgaagtcagaataccgcccatacattgtgggcctaagcaggttacgagggtctcggcagagacccagaggcatgctctagaaattgctgtgaccctggagcagaaacatgtggcagtccccagcagagctcacctacgctgctctcctcgcttaacacgcctcaggaaaggcaaaatggcagctttacaaaacgaagttttattccatttccccttctcccctcttaattctcatagatcgctgcagtgaatgcttttaacctgtcaactgtgatgaaacaaacagaaaaccgaagccctggcttcttctgaggtgcaaataaatgaccgagaaggtgttatctaagacctctacagccatttgtatctggccgtgtgtagagtgggctctgcaagaccctgcctcactttcccactaagaggccttggacttcccagctcccagagactgtagagatcacctctgtggcctcctgtcacgatttcctaaggcgaagagcttcatttgcccaacggaggcccacgttcttcctgtctgatctactgtcttcccaaggatctgaactcgggcaccagcgtctgcccacatgtccgacgaaaacaacgtaaaggaactactgagtctggacagaaaatccagacataccatgcagcttctaagaggaccgagtgccttcactggaatagtgaatctccttctgtggacatggacagggaacggctcgataaagcccagattcacaaaattccgcccacaccccgtgcccccgggaattttggcttaggggcaggatatgggggttaccactgtgctagtggaggtggcgcggggactgaacggcagccccagcgcagttctccccacgtttgtccgcagaaccccggcgaggccgaggtggtcatttccctccctagccggatggccgcgccgggtgaggccggtttgggcgcgaagcacgggcgtgtggcgctccacttccgcaaaggccagccgcgctcaggaccgcgagccctgagcgtccccctagtgacccctggcctcgtgcccgacgccccgtctctcctgccccggcccccccgccacgcagggccccggtcacgcgcggggggagccggaccgccaaagcccgcgagccggcgcccaggaaagcgtccgcagcccggccagtgcggataggccaattggccgaagtcggcaaagctcaagacggcaccgcagcagggggacccgaccccgttttgttgggagcctaagcggaagtgccttccccgctctaatgccggaggagcacggagggcaagcggtacagcttcttccaagtgctgatgtgggtggctctgaaaagagccttttggatacgatggaacctccggccgaaccgccacttcttaagcccgctctccacggatgcggcgggccagctggatgtccttgggcataatggtcacgcgcttggcgtggatggcgcacaggttcgtgtcttcgaacagccccaccaggtaggcctcgctggcctcctgcagcgccatcacggccgagctctggaagcgcaggtccgtcttaaagtcctgcgcgatctcgcgtaccagccgctggaagggcagcttgcggatcagcagctccgtggacttctggtagcgccggatctcccgcagggctacggtgccgggccggtagcggtgcggcttcttcaccccgcccgtggccggcgcgctcttgcgggccgccttggtggccagctgcttcctcggggccttgccgccggtcgacttgcgagcagtctgcttagtacgggccatagcgaaccaaaacacaggcttaccagcgcagcggcggggagaaaaacgagctcctagccccgccgcagccgtctttataagcacagtcttttcccgattgggcggaacaataattgaaaatcccgcgctggctgtccattggctgtgacgtcacccgtcctaaagtcaccggttggcttgggcagattcctccctaatcccgcccaccccgcctcactttctacttaccagttggcgaagtttcgcaagcttgtttttcccctttccttcagggtgaaagtcattttccattgcagctttgtcagattgttccctttccgcccttcgcttccttagaacacactgcccgcaataccccccctttcttgctgcgccctacagctcccgcgtggaacctcattcttccatttgccccccgcccccagttgctacttggcggatcgtttttcgcctgtcgggtgccttttgggtgggagaggtgcccgcccccaggacgcaagattccgcctccgaggcccttactctccgccgccagggcgctttggaaaacaaaacagaaactaagacttaagtcagctcagtgaagccaagacccagctccgccacactagcgagcactacccgctcagggccctccccatcgggggtggggacgaggagcacgtcccgctggtgccagactaggtctaagtgtccggccatagcctgcggaaaccactagggaagcgcgcgctccgcgcgcaacacttcagcgcgttgggtactgcccgcggcgctggtgtttgtgactgtgtggagcggaccgtggcggcgcccaggacgtttggtgcctgcacctgccctgggaagtcctaggactggggacccactcatcgaagagccaaggcagttacgtgctccagatggaagacggcgcgcacacacacacaccccgccccgccccgccccgtcccgtcccgtcccgtcccgtcccgtcagctccaggttcgctattcactactgaggaacgctggactgagagtggccagcattaacaactcttttatttgaaaacgtgggtggctctgaaaagagccttttgagttcacaggtgccccttcgagacgcgggccgggctgggcccacttgggccggacgtcagcctcacttgccctttgccttgtggtgactctccgtcttcttagggagcagtacggcctggatgttaggcaagacgccgccctgggcgatggtgactttgcccagcagcttgttcagttcctcgtcgttgcggatggccagctggaggtgacgagggatgatgcgcgtcttcttgttgtcccgagccgcgttgcccgccagctccaggatctcggcggtcagatactcgaggaccgcagccatgtagacgggcgcgccggcccccactcgctccgcgtagttgcctttgcgcagcaagcgatgcactcgccctaccgggaactgaaggccagcgcgggacgagcgcgacttggccttggcgcgggccttgcctccttgcttgccacgaccagacatgacagcgatagtagtcaccgagagaaactcctgcctggcgatcgggaaagtcgccgaaaacgccgctgcttcacctttttatagacagaacggcgattgtccacggagcactttgattggctcaagcaaattttgtcccgatagccaataggatagctcagccagaatccactcatttacataatctcgtctccctcgcattgcgcgccgcggaaaactcgcgaaccataacgcagcgtcatgcgcacagcctctgtaagtacacagtcgtttccggtagaccccgagcctaccgctctgcttgcgttctcgggggtcggtgtcggtcttgggtctggccatgcctgagcctgcaaagttcgcgccggctcccaagaagggctccaagaaagccgtcaccaaagcccagaagaaagacggcaagaagcgcaagcgcagccgcaaggagagctactccatctacgtgtacaaggtgctgaagcgggtccaccccgacaccggcatctggtgcaaggccatgggcatcatgaactccttcctcaacgacatcttcgagcgcatcgcgggagaggcgtcccgcctggcgcactacaacaagcgctccaccatcacgtcccggagatccagacggccgtgcgcctgctgctgcccggcgagctggccaagcacgccgtgtccgagggcaccaaggcggtcaccaagtacgccagctccaagtgagtccctgccgggacctggcgctcgctcgctccctccctccctccctccgcgggtcgccggctgctttgtctccaaaggctcttttcagggccacttaaccccgttagtgaaataagctgttttcccactgcttactgtgagttctacttaggggttttccctcagcacctatcccttttcctgcagatgatgggagaggaatataagataaagctataagatgtagcttggtcgagaactaccttgtagtgacagggtcatgtgcacataatttgccttttccaaagtgagacgatatgctacgggtgcggtcaatgtaaatctgctcaggagagtcgagggaaaaagtgttaactgcatattgagctcgcaaaattgtgtagtaacctgaaaatattcctaatagttttgcgaccaagcctcaccatataaactttccttccgcacctgtagacctccattctgtggttgaagcaatttttggtttatatagctctcttgtctcaatttggtattcctttcaggtactgtgagtctataggtatttatttctgggtttcaagacgttaaatgccatcagaattgagtaatgcaaaggctgctgtcatggatagtaaagctttttagtcaagtgctgatagacaattccccattgttatcgttgggtattttacaattttctgggcaagaaatgtaatgaaaaattaagtaagttttaaaggccttcgtctttgagactggatacctaaaacaatagtgtttcctaaacagttaaaacttatttaaccctgaagctttcgagacacacaaatatatacaaatatatattgtatatttcttaaaccccacatagttccactgatctaaatcactgggggcgagaggcaaggatagacaatctatgacacaacaccaggtgattcataagtttggtaaccactgacatttgattatgcagttgccatattccttagtaagaacctggtcacaattttcactcactaccccaggcaattccccctccccacaccccccttttttctgagaatttcagtgagatatacaaaagtttcatttaatcctttattaattccagactttatatatttttattaggatttaaaatacatttcaaaaagatcaagtgagaacagaagataaaagtaccaagataaaggcataatacaaacttagaaaatacatgttaagcatactgcggcgtcctggtagccccttgcttttgttcacttttttctcttatgtacctacataaaatcccaaatagtatcttccaggatgacacacttgctgtctgccccacccaattaaaaacagattttttagttattaggtattgtgctgaatctaccttattttattgccaaaagaaaaaaaaaaaaaagcttttcaaagcttcatccccaggaaacattttcctgcttttacacataccttatatggctctactgagagataaggcctaagcctgaaaagttaatttaaagcatggaggtaggggtgagacagaaagacaacagggaaaagttgagtttataaggtaagtatatatcttccttttaacagccacctgcatggcgttcggtaaataacctaattatatgtgggggaaggtagtggtcaacatttggtcctggggactgagaataagagcaggaaagcaataaacagctaactatgagagtgacttaatgtaattatattacctgtcaatcgctacttttcctttcttaccaaaattcacacaggtatgaaagcaatatgacattcaggctccattatgtgtatttgtgcacatcacttcccacgataagggagaagaaaagaaaccactgcacattcggataaaacatgctgggaatacagcagtaaacagaatagaaaaagtctacattttaattagcagataagtaaaaataagtgactaaatgtatattattcagggggccatatgtgcaattgctgttaagtaaagcagaacatggagtggagtagggatgacaggtttcatcagttaatacttgagcagagagctgaatacagtaagatagttgtaggatatcttgaggcagagtattctcagaacagaacatggtaagtacaaaggccccaaggcaggaacaagcttggtgaatgtgagaaatatgcaagctggttaatgtggctgaagcacagtgaccaagggaaagttttacagagatcacggaggtgcttgagggctggattatgtaggccattaaggagcatcacaggccactgcagagattttgtcttttaaatgagatagagtgctcttggagaatgtgactggagaggccgatggtagcagtggagatgcagagtagtagccgagatattttaaatgaaattgatttagtataggctgactgaaagagaaatcaaggattaattgtaggtttttacactgagcacttgaaaagagctgctatttgctgatatgagtaaggagtagtcttggaggaagaaaaccaagagtactgttttgaacaaaatgttgaagactcctggtaaatatcgaagtgtaaatatcaaataggaagtcagaaatatgagaatctggagtttaggaaagagaagggggttaggtttgtaagatctcatatcagtctgattcttatttttttgtagataatctaccctttctttctgtaaatgtttagaagcatgatgtctatgtgtgtatatatacacacacactcactcccccccgccaggactgcctcagttttcatctcagtatttgactaaaaccttctattcaacttcagtttcagccttagaataaccagatgtctaagtcaatgtcatttggggcatctctagacttgtgcaatcacaaaagtcaccattaccgctacatagtacgtattatgaccaatggatatcattcagagttctagtttacatatgctattatcaaacatatgtaagccttttaatgtaacttgggagtgaaattagtaaaattctatcaatttacataaattaattttactgtaaaaataaaatacattatgaaagtttctgtactaatgtctttgattacaatttttaaagtatttcccatttttttattttgaaaattttaaacctacagaaaagttggaaaaaaaagtacaaagaccagccatagtcccttcacctggattcaccaattattacaattttgctgcatttgccttatctttgtcttctcatgtacacagacagcctctgaaccatttgaaaataaactgcaaatatgttggcacttctccctaaatatggtggcatgtctcttaaaaataggatattctcctaaatagctacaatcacattattacacctaacaaatttaatgctgattcagtaatattaatatgcaatccatattcaaatttctccaattattgaaaaaattctatatagatgttgtattagtttcttgtggctgctgcaacaaattactacaaactcaatggttttaaaacaacagtcattctcttacagttttggaggtctgaagtacaaaatcaattttactcggtagaaatcaaggctgcactccctccagagaccttaagggagggtctatttccatgccttttccagcttctagaggtttatttctggtttatggtcccttccctctgtcttcaaagcaagcagcctattaatcttcaaatccctctctccttctatcgcctccttctacacttgactttcttgcctctcctataaggactgtggtgattacatttggggcctacctggataatctggcataatctctcaatctcagaatcacatctgcaaaatcctcttggctatataaggtaatattcacaggctgtagggattaggatatggacatatttgggagccacatttagcctgccacagccattgactactgttatgggttgagttgtgtccccccgaaagatatgttgaagtctaacccctagttgcttagaattttgccttctttggaaacagggtctttacagaggtaatcaagttaaaatgaggtctttagggtgggccctaatccagtatgactgatacccttataagaagacatggagacagccgggtgcagtggctcacatctgtaatcccagcactttgggaggccaaggcaggtggatcacctgaggtcagttcgaggccagcctgactaacatgatgaaactccatctctaccaaaaatacaaaatcagccgggcgtgctgacgcatgcctgtaatcccagctactcgggaggctgaggcaggaaaattgcttgaacccggggcacagaggttgcagtaagccaagatcatgccactgcactccagcctgggcaacaagagtgaaactccatctcaagaaagaaagtaaaaaaacatggagacatacatgaaaaaactgaggtagagattacagttatgctgccagaaaccaaagaacaagtggggctaccagacactgaaagacaggagtcttcccctagtgggtttggagagagcatggccctaccaacacgttgatttcaaacttctagcctctaaaaccatgaaagaataactttgtgttgttttacgccatacagtttgtggtactttgacagccccaggaaattagtacaactactaaaattttttgatttagtttatttaaaatttttaaataaaatttcacatctgaaaaaaaaccctggacatttttcctgtgatggtaatattagtctttagccttagtcaagtattaacatttggacatctgttccaaatatgtaattggagcaactctgtcctaattgaccctatttgacttgagacctttcatgaaaggtctttccttttatctaggaaattattattcctgaaatatttcaagattcaaactggtataagtaaatatgtcagacaaattggcttaactggaagtccaaaggtgcagcagggatccaaggttggctgaactccatgagtggctcagttccctgattctcccacactgtgtcctcctctgcatattgtctataatcattcttgccttcatacctaaagacagtccatcctcctgctgcctcttgaaagcaaataagctgctttcccaaaagataatagcatactacactcccctgctgagttagttgttactcagttcacttcctgaaatgttaaatgccaatgagtttgatctagattcctgaactaatcacagtaagaagcaggttcagacagcaattaaactaatcaggccaaccctaagaactgtgggtaaaatgcgtttctgggaaacacatgtggcagcactataacagaaacaattagaaaaataaatgctacctagtcaataacatacattataggactatgaactactaagttacacctcatgacaaacacatgagtaataaagtctagaaaaatacttaaaggtgatgtccatcattctcattgctgtgttcacagttcacaggtagaccctaaagacaggcttgtgttgtctttactgaaccctagatgcatctctcaaactgtcaactgcacatatccacttgaatagcaaagagcttctcaaatttcagtcggaactctggatctcccttcagtgtcccaacgaatatcttctctcagtgttctatcctaatagtaccactatgtacacagttgctcaagccaaaaatctaggggtttcactgttagctaaatcctgttcctcagccacacctattaattctacctcaaagataaaatccaacatttgtttccattaccaccattgcactccagcatgtcatttatccgttgtttttcacactttagcatatatcaccatcacccagaaagcttaacacaaataatggaacctgggaattttcatttttagtaacttcaagtaatgctgatgctgctggtctggagagactttaagtcttaatcactgttccagcccacaacactgcaacagcctcctaattgctttcctcgcttctattgtggccagcctaggatttacgatccccagagcaatcagtataatattttgaggttaatgaggctgtgtgattccaagtccagtgttcccaaagcagaaaacaaacctaatcaacctcccttgcaaattggtggtccttctcctcttcagggatcccaaactctggcttcagaaatcgtatattttgttgctattgtatggaacaaacccttaaactggacaagcttttccgagtgataactcttggggaaaaaaaccatttaatggtattgggtagattttagggtatctcaactagaaagcgcagaaggttatcggtgttaactcctggttatcaaaatcgaacttccatctacctccttaaggaattttcacatgagtggtggtgtaggcacgtgtttgtgaaccaatgatataaaaacctcaggtttctcgataccatatataaaagttgagctattcccttttaagtacacatctgagagcatacaatgcatttaatctctaccttcattttaccactgaagagcggacccaacctttgttcatatacacaatttgatcttacataaacttatcaaaattaacactgcgtttctcaacaggaaacaatctcctgggcacatattcacgggtacgtaaccaggccaaagacagttcaagagcagccctctaaggcaagccccaacctatctatgccatagtaagataccactatcaatctatgtaagcttacttatagcaatgcctatgtgaaaagaaaatagttatctgtgcttggtgttgtgtgctctcctaaagttaaccagacgtgaagccaaaaacatcaactgggactgacaacacaagaaagattctttaactgaggtggttaaatggccctgaaaagagcctttggagacaaagcagccggcgacccgcggagggagggagggagggagcgagcgagcgccaggtcccggcagggactcacttggagctggcgtacttggtgaccgccttggtgccctcggacacggcgtgcttggccagctcgccgggcagcagcaggcgcacggccgtctggatctccgggacgtgatggtggagcgcttgttgtagtgcgccaggcgggacgcctctcccgcgatgcgctcgaagatgtcgttgaggaaggagttcatgatgcccatggccttgcaccagatgccggtgtcggggtggacccgcttcagcaccttgtacacgtagatggagtagctctccttgcggctgcgcttgcgcttcttgccgtctttcttctgggctttggtgacggctttcttggagcccttcttgggagccggcgcgaactttgcaggctcaggcatggccagacccaagaccgacaccgacccccgagaacgcaagcagagcggtaggctcggggtctaccggaaacgactgtgtacttacagaggctgtgcgcatgacgctgcgttatggttcgcgagttttccgcggcgcgcaatgcgagggagacgagattatgtaaatgagtggattctggctgagctatcctattggctatcgggacaaaatttgcttgagccaatcaaagtgctccgtggacaatcgccgttctgtctataaaaaggtgaagcagcggcgttttcggcgactttcccgatcgccaggcaggagtttctctcggtgactactatcgctgtcatgtctggtcgtggcaagcaaggaggcaaggcccgcgccaaggccaagtcgcgctcgtcccgcgctggccttcagttcccggtagggcgagtgcatcgcttgctgcgcaaaggcaactacgcggagcgagtgggggccggcgcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgtcttgcctaacatccaggccgtactgctccctaagaagacggagagtcaccacaaggcaaagggcaagtgaggctgacgtccggcccaagtgggcccagcccggcccgcgtctcgaaggggcacctgtgaactcaaaaggctcttttcagagccacccacgttttcaaataaaagagttgttaatgctggccactctcagtccagcgttcctcagtagtgaatagcgaacctggagctgacgggacgggacgggacgggacgggacggggcggggcggggcggggtgtgtgtgtgtgcgcgccgtcttccatctggagcacgtaactgccttggctcttcgatgagtgggtccccagtcctaggacttcccagggcaggtgcaggcaccaaacgtcctgggcgccgccacggtccgctccacacagtcacaaacaccagcgccgcgggcagtacccaacgcgctgaagtgttgcgcgcggagcgcgcgcttccctagtggtttccgcaggctatggccggacacttagacctagtctggcaccagcgggacgtgctcctcgtccccacccccgatggggagggccctgagcgggtagtgctcgctagtgtggcggagctgggtcttggcttcactgagctgacttaagtcttagtttctgttttgttttccaaagcgccctggcggcggagagtaagggcctcggaggcggaatcttgcgtcctgggggcgggcacctctcccacccaaaaggcacccgacaggcgaaaaacgatccgccaagtagcaactgggggcggggggcaaatggaagaatgaggttccacgcgggagctgtagggcgcagcaagaaagggggggtattgcgggcagtgtgttctaaggaagcgaagggcggaaagggaacaatctgacaaagctgcaatggaaaatgactttcaccctgaaggaaaggggaaaaacaagcttgcgaaacttcgccaactggtaagtagaaagtgaggcggggtgggcgggattagggaggaatctgcccaagccaaccggtgactttaggacgggtgacgtcacagccaatggacagccagcgcgggattttcaattattgttccgcccaatcgggaaaagactgtgcttataaagacggctgcggcggggctaggagctcgtttttctccccgccgctgcgctggtaagcctgtgttttggttcgctatggcccgtactaagcagactgctcgcaagtcgaccggcggcaaggccccgaggaagcagctggccaccaaggcggcccgcaagagcgcgccggccacgggcggggtgaagaagccgcaccgctaccggcccggcaccgtagccctgcgggagatccggcgctaccagaagtccacggagctgctgatccgcaagctgcccttccagcggctggtacgcgagatcgcgcaggactttaagacggacctgcgcttccagagctcggccgtgatggcgctgcaggaggccagcgaggcctacctggtggggctgttcgaagacacgaacctgtgcgccatccacgccaagcgcgtgaccattatgcccaaggacatccagctggcccgccgcatccgtggagagcgggcttaagaagtggcggttcggccggaggttccatcgtatccaaaaggctcttttcagagccacccacatcagcacttggaagaagctgtaccgcttgccctccgtgctcctccggcattagagcggggaaggcacttccgcttaggctcccaacaaaacggggtcgggtccccctgctgcggtgccgtcttgagctttgccgacttcggccaattggcctatccgcactggccgggctgcggacgctttcctgggcgccggctcgcgggctttggcggtccggctccccccgcgcgtgaccggggccctgcgtggcgggggggccggggcaggagagacggggcgtcgggcacgaggccaggggtcactagggggacgctcagggctcgcggtcctgagcgcggctggcctttgcggaagtggagcgccacacgcccgtgcttcgcgcccaaaccggcctcacccggcgcggccatccggctagggagggaaatgaccacctcggcctcgccggggttctgcggacaaacgtggggagaactgcgctggggctgccgttcagtccccgcgccacctccactagcacagtggtaacccccatatcctgcccctaagccaaaattcccgggggcacggggtgtgggcggaattttgtgaatctgggctttatcgagccgttccctgtccatgtccacagaaggagattcactattccagtgaaggcactcggtcctcttagaagctgcatggtatgtctggattttctgtccagactcagtagttcctttacgttgttttcgtcggacatgtgggcagacgctggtgcccgagttcagatccttgggaagacagtagatcagacaggaagaacgtgggcctccgttgggcaaatgaagctcttcgccttaggaaatcgtgacaggaggccacagaggtgatctctacagtctctgggagctgggaagtccaaggcctcttagtgggaaagtgaggcagggtcttgcagagcccactctacacacggccagatacaaatggctgtagaggtcttagataacaccttctcggtcatttatttgcacctcagaagaagccagggcttcggttttctgtttgtttcatcacagttgacaggttaaaagcattcactgcagcgatctatgagaattaagaggggagaaggggaaatggaataaaacttcgttttgtaaagctgccattttgcctttcctgaggcgtgttaagcgaggagagcagcgtaggtgagctctgctggggactgccacatgtttctgctccagggtcacagcaatttctagagcatgcctctgggtctctgccgagaccctcgtaacctgcttaggcccacaatgtatgggcggtattctgacttcaaaaagtagtgactttcagaggtgggtgggtcactatctctgcacccagcttctcaggcccagtagtaactgagcagagactggaacctggggatgttggtgtcagacatctaggtcctctgactgcccccacaaggtcacactccttttactcaccagtctgggtacctctaaactccaggaggtctccctggctgaatctcaaaaggaaaatttcgtggcattttttatatccagtcaggaatagaattcattacatcttgtggtcctggcactgtgaaggcctgcactcacaggaatctgtcagtcttcgtatttgtttgcgagaccagcataagctgaattcatcaatacaagataacattctaaaatgttaagttttaacatttaatcattccctgtacttaaatcattgtctaccctcaggtgagagttaaaggataattaaggatagggtaaagaaatactcttcctctgactaggcattgtggctcacagctgttaatcccagcactttgggaggccaagtcgggcggattgcttgaagtcaaagttccagaccagcttgggaaacatagcgagaccctgtgtctctaccaaaaaaaaaaaaaaagacagaaagaaaaatgaaaaaattagccgggggtggtgccatttgcctgtggtcccagctactcgggaggctgaggtgggagaatcgcttaagtccgggaggcggaggctgctgtgagctgagattgtgccactgcactccagtgtgggtgacagggagtgagaccctgtctcgaagaaaacccacctcttcctctaataaccagcttctacgtggctaccttggttgccagtaagtccactctgaatctgtggcttttatgaagtgaaaaacgtgctttgttcacatttaattctgccttaggctagtgggggacaggtgtgtgtgtgtgtgtgtgtgtgtgtgtgtgtgtgtgtgtgtgtttagagggaaactacgtggtaagagacatggccacgtttacactgatttttcttccttagaagaggacttgtcccctgggtccactctcctggtcacccttatccttctctaggtccccatctcagtcttctcatgtctttctcttccccatcaatattcctggtttcccccatgctggccttggccatcttcttttctccctgcaactcaagtgagattgattgcctgctttcactatttctgtcccttagctaagcgctcccaaattgctatcttctgctgagaccctatcctgagctctacacattttgtgtgtgtgtgtgtgtgtgtgtgtgtgtgtgtgtgagagagagagagagagagagagggagatagagagagaaagagaaacagggtctcactcgtccaggctggagtgcagtagcacaatcaaagctcactgcaaccttggactcctgggttcaggggtcctcccacctcagccatctgagtagctgggactacgggcacacaccaccaggcccagctaattttttttattttttgtagagtcagggtctcacttcatcgcccaggctggtcttgaagtcctgggctcaagccctcctcccaccttggcctcccaaagtgctgggattatagacgtgagccactgtgcctggctacaccaatgtttctaactgcctggtagacaggtccttctggatggatactaggcacttcaaacccagcttatttccaaaaccacatgcctcatcttgctttccaagcccatttgtttctttccacattccccatcttcctggaagacaccttcattagccccatctgttctggttgggtgtcccttcctcttgtcctctgtccaaatctcatgagttccaaatattactaaatctgtcttctgactttcaattgtatcaccttttctccgtccacccatgaccatgccttaactgaagtcctcgccagctctggtctagtagattacatagtcaggctggtctttctgccctgccattgagcttccactccgtatgacagctatctttttttttttttttttttttatgagacggagtctcgctctgtcgcccaggctggagtgcagtggcacgagctcggctcactgcaaccttggcctaccgggcccatgcgattctcctgcctcagcctccggaatagctgggactataggcgcccaccaccacgtccggctaattttttgtagttttgtattttttgtattttgtgatccgcccgcctcggcctcccaaagcgttgggattacaggcgtgagccaccgcgcccggccaagagctatcttttaaaaactgagggttttttgttggttggttggttggttggtgttgctgttttgagcctgtcactttcatgcttaaaaattttccacgaccttcccattcccttcagaatgaagttcacattcttttgcatggcagttcagagcaccggaggttaattactaggaaggactctggagttagacaaacccaagtttgattcctagccttgtccatgtaaacaggtgcatgacttcaggaagcaaatctcaacaggtttaacttttcccatttgtaaaacaacgagtaacttgctcgttgttttgttggaaatcatgaaagtgacaatttctgtaaattgcggtgctcatgcctgtaatcccagcgactcaggaggctgaggcaagaggattgcttgaggccagaagttcgaggctgtggtgagctgtgactgtgccactgcacttcagcctcggcaacagcagtgagaccccatgtctaaaaaaacaaaggacctagcacagtagtagcacagtatctggtccagaacaagcacccaattaatttgtgctactctattaatagttactaatttaaaaaaaaactgaaaatattatacatctagttctttatgtttcccacagccttcccaggtttcagatgttcttgcagctgaacaagaatgtttagccccacacgacatctgcaatctccaagtacacaatatcttcacacattccatttctgtccagaatgtcctccccttctctgtaaccctgagaacccccattcttcaagattcagccctgtgagccttcccttgctcttctggttttttgttttttctttttctttcttttttttcttttcttttttctttttttttttttttttgagatggagtcttgctctgtcacccaggctggagtgcagtggcgcgatctcggctcactccaaccaccgtctcccgggttcatgcgattctcctgcctcagcctccggagtagctgggactacaggtgtgtgtcaccacgcccagctaagttttatatttttagtagagacggggtttcaccatgttggccaggatggtctcgatctcttgacctcatgatctgtctgctttggcctccgaaagtgctgggattataggcatgaaccacagtgcccggctcccttgctcttctttgccctcatctctttgggccctcctccttgcctctgccctctcctatcttaataccccttcccttccttaacctcagcattaggctggcaacatttctcagggtaaggatttgtctttgtttatttccatagtagcagcagtacccaagcaacgcctggtcacagtaagtcgagtgaaaccatctctcaaaaaaacaaaacaaaacaaaacaaaaaacgaactacattgagtgggaaaggcaataaatatatcacctttggtttctgtatcacttcatggcctcattcttctttcacacagaacttttcatttgatccttaaaataatcctgtgaaaaaggcaggaattctcagtaattggccgggcaccgtggctcatgccaaagaaaaagaggccaggcgcggtggctcacgcctgtaatcccagcattttgggaggccgaggagggtggatcacctaaagccaggagttcgagatcagcctggccaacatggcaaaacctccatctctactaaaaatacaaaaattagcccggcatggtggtgggcacctgtagtcccagctacctgggaggctgaggcaggagaatcacttgaacccgggaggcggggattgcggtgagccaagatcgtgccactgcattccagcctgtgtgacagatcgagactccatctcaaaaaaagaaagaggaaggaagggaaggaagggaaggaagaaaggaaggaaggaagggagggagggagggagggagggagggagggaaagaaagaagaaaagaaaaaaagaaaagctgttacctgcatcagtggctttcaacctttaatgtgtatcgggagggcttttttaaagcaccgattactatgtctcacccctcagtttctcattcagtaggtctggcatgggtcccaagattttatccgaggtgatcagtgctgctagatgagaggctacactttgagaaccactaattcagacaatggacgtgttttctcccccactccctttctgctttatcttcaaatttttgatctccttctttagtggatcttggtgcggatcagatatattcatcagcattgcctttaaagttaaaaacaatcagtgatattcgaaatagcaatgctggaaatcacaggtcagatttaaaagggaaaaggaaacatcttgagcattaaaacctctatttctcacctggacatcttcacaaatgttattcttgccacttcctccctgccctcgccccctttactatgtatctcagtaggacgccaatcattctgctctttattcagagtccgacacaagcccccacgtccatagccaagttttccccggtttcccagcagccagtgacttctgtagcattaggattcttatagtagttattgtctacatttctcagcagattgaatatgtactgcctcttactactggactgtttattcttaaatgtgtacagtatggatttatgtcgtctatatattatgcatttatttgtcttcttcgttgtgatggtaagctcctggagggcaagtcttgcatccactgctttgctggcaacccgactggtaagcttctggaaggcaaggcttgcatccagtgctttgctggcaacccgattgctaagtaccgtgttttaagcttagttcagtctcaagtgtttgcagccacatctgaagaccaataaagcaactgctggtttatcctttgggagctgacagaatttcttctcccaaatacatacacagtaaaatcataagcctggaatgaagaaaaaaaaaatcttacgggcaatgcaatggctgcaaaactataaggattagaaatgtgaacccacattttaatccaaattagggcaatttagaggtggtagcgtaaagaatagcttgctgtaatatacgccatgctgatacagaattggcttttggccttgtcaaaattaaattgtgctttctgtattgatggtgggcatgtttctgcaggtctctcattctaagctacaacaggccctaagaggtagaagtcacatacctgaattacctgtgaagttgctttcagatcatatcgttggttcactcttacagaaggatcactttaaaatatctctgcatttgtatccttgcaatgccacaactaaaagacagttatctcataggtccttgattaaattaggaggctttttattgaacacaagaaatgatacttttcaggcactgggcagataacttgctagaaaggcattttttaactgtgctaagattgagctgagtgcgtggctggagacaccacacaacacggacccttgctaaggcatctagtccacccgcttgttatgtagagggtgaaatgaagcccaaaacagtcaatcgtgaactctaagccgatcaggtgggaaagccggcatctctagaatgaaaacctaaggctgcttctcccactttgcctgagcaaatatagtgagattacacagcaaggcatgtgtaaattgccagtgcctatttctcagaaccagatttggtgatcgcaaagactgacgtggccctctaggtgtgcctatactgcaccagaagagcaagccgagaaagcagtgctcaaacctagagcattcaacctttcataccgataaaggctttaaaaaaaaaaaaaaaaaaaaaaaaaaagcccaggtaagtgaaaaagccgctttcggtcaacgacttaagtctttacggctgtgagcgctatgggccgcggtagctttccgttaacttcagatccgattgtcgccccactgccaaagttaccttccaacatcgttactgttgcactttacgcagtcaagtgtccaactcctcagatgagcaagtggtcggccctaaaaagggcctttgggatcgaaacgtgcaaagctggagcggcggcctagcctccgaagccgtacagggtgcgcccctggcgcttgagcgcgtacaccacatccatggctgtgacggtcttgcgcttggcgtgctcggtgtaggtgactgcgtcccgaatcacattctccaggaacaccttcagcacaccgcgggtctcctcgtaaatgaggccagagatccgcttaacgccgccacgccgagctagacgccgaatggcaggcttggtgatgccctgaatgttgtctctcaagaccttgcggtggcgcttagcgccccctttgcctaagccttttccgccctttcctctgccggacatgaccgctggagcccgatagacagcttct

SEQ ID NO: 1092 - DNA, 28505 bp, Homo sapiens; identical to SEQ ID NO: 1091
